United States Patent 7,709,616 (MICRORNAS AND USES THEREOF) - sequence listing, part 24

SEQ ID NO: 754014 - RNA, 64 nt, hsa; identical to SEQ ID NO: 55307

SEQ ID NO: 754015 - RNA, 64 nt, hsa; identical to SEQ ID NO: 55308

SEQ ID NO: 754016 - RNA, 64 nt, hsa; identical to SEQ ID NO: 55309

SEQ ID NO: 754017 - RNA, 64 nt, hsa; identical to SEQ ID NO: 55310

SEQ ID NO: 754018 - RNA, 64 nt, hsa; identical to SEQ ID NO: 55311

SEQ ID NO: 754019 - RNA, 64 nt, hsa; identical to SEQ ID NO: 55312

SEQ ID NO: 754020 - RNA, 64 nt, hsa; identical to SEQ ID NO: 55313

SEQ ID NO: 754021 - RNA, 64 nt, hsa; identical to SEQ ID NO: 55314

SEQ ID NO: 754022 - RNA, 64 nt, hsa; identical to SEQ ID NO: 55315

SEQ ID NO: 754023 - RNA, 64 nt, hsa; identical to SEQ ID NO: 55316

SEQ ID NO: 754024 - RNA, 64 nt, hsa; identical to SEQ ID NO: 55317

SEQ ID NO: 754025 - RNA, 64 nt, hsa; identical to SEQ ID NO: 55318

SEQ ID NO: 754026 - RNA, 64 nt, hsa; identical to SEQ ID NO: 55319

SEQ ID NO: 754027 - RNA, 64 nt, hsa; identical to SEQ ID NO: 55320

SEQ ID NO: 754028 - RNA, 64 nt, hsa; identical to SEQ ID NO: 55321

SEQ ID NO: 754029 - RNA, 64 nt, hsa; identical to SEQ ID NO: 55322

SEQ ID NO: 754030 - RNA, 64 nt, hsa; identical to SEQ ID NO: 55323

SEQ ID NO: 754031 - RNA, 64 nt, hsa; identical to SEQ ID NO: 55324

SEQ ID NO: 754032 - RNA, 64 nt, hsa; identical to SEQ ID NO: 55325

SEQ ID NO: 754033 - RNA, 64 nt, hsa; identical to SEQ ID NO: 55326

SEQ ID NO: 754034 - RNA, 64 nt, hsa; identical to SEQ ID NO: 55327

SEQ ID NO: 754035 - RNA, 64 nt, hsa; identical to SEQ ID NO: 55328

SEQ ID NO: 754036 - RNA, 64 nt, hsa; identical to SEQ ID NO: 55329

SEQ ID NO: 754037 - RNA, 64 nt, hsa; identical to SEQ ID NO: 55330

SEQ ID NO: 754038 - RNA, 64 nt, hsa; identical to SEQ ID NO: 55331

SEQ ID NO: 754039 - RNA, 64 nt, hsa; identical to SEQ ID NO: 55332

SEQ ID NO: 754040 - RNA, 64 nt, hsa; identical to SEQ ID NO: 55333

SEQ ID NO: 754041 - RNA, 64 nt, hsa; identical to SEQ ID NO: 55334

SEQ ID NO: 754042 - RNA, 64 nt, hsa; identical to SEQ ID NO: 55335

SEQ ID NO: 754043 - RNA, 64 nt, hsa; identical to SEQ ID NO: 138909

SEQ ID NO: 754044 - RNA, 64 nt, hsa; identical to SEQ ID NO: 138910

SEQ ID NO: 754045 - RNA, 64 nt, hsa; identical to SEQ ID NO: 138911

SEQ ID NO: 754046 - RNA, 64 nt, hsa; identical to SEQ ID NO: 138912

SEQ ID NO: 754047 - RNA, 64 nt, hsa; identical to SEQ ID NO: 138913

SEQ ID NO: 754048 - RNA, 64 nt, hsa; identical to SEQ ID NO: 138914

SEQ ID NO: 754049 - RNA, 64 nt, hsa; identical to SEQ ID NO: 138915

SEQ ID NO: 754050 - RNA, 64 nt, hsa; identical to SEQ ID NO: 138916

SEQ ID NO: 754051 - RNA, 64 nt, hsa; identical to SEQ ID NO: 138917

SEQ ID NO: 754052 - RNA, 64 nt, hsa; identical to SEQ ID NO: 138918

SEQ ID NO: 754053 - RNA, 64 nt, hsa; identical to SEQ ID NO: 138919

SEQ ID NO: 754054 - RNA, 64 nt, hsa; identical to SEQ ID NO: 138920

SEQ ID NO: 754055 - RNA, 64 nt, hsa; identical to SEQ ID NO: 138921

SEQ ID NO: 754056 - RNA, 64 nt, hsa; identical to SEQ ID NO: 138922

SEQ ID NO: 754057 - RNA, 64 nt, hsa; identical to SEQ ID NO: 138923

SEQ ID NO: 754058 - RNA, 64 nt, hsa; identical to SEQ ID NO: 138924

SEQ ID NO: 754059 - RNA, 64 nt, hsa; identical to SEQ ID NO: 138925

SEQ ID NO: 754060 - RNA, 64 nt, hsa; identical to SEQ ID NO: 138926

SEQ ID NO: 754061 - RNA, 64 nt, hsa; identical to SEQ ID NO: 138927

SEQ ID NO: 754062 - RNA, 64 nt, hsa; identical to SEQ ID NO: 138928

SEQ ID NO: 754063 - RNA, 64 nt, hsa; identical to SEQ ID NO: 138929

SEQ ID NO: 754064 - RNA, 64 nt, hsa; identical to SEQ ID NO: 138930

SEQ ID NO: 754065 - RNA, 64 nt, hsa; identical to SEQ ID NO: 138931

SEQ ID NO: 754066 - RNA, 64 nt, hsa; identical to SEQ ID NO: 138932

SEQ ID NO: 754067 - RNA, 64 nt, hsa; identical to SEQ ID NO: 138933

SEQ ID NO: 754068 - RNA, 64 nt, hsa; identical to SEQ ID NO: 138934

SEQ ID NO: 754069 - RNA, 64 nt, hsa; identical to SEQ ID NO: 138935

SEQ ID NO: 754070 - RNA, 64 nt, hsa; identical to SEQ ID NO: 138936

SEQ ID NO: 754071 - RNA, 64 nt, hsa; identical to SEQ ID NO: 138937

SEQ ID NO: 754072 - RNA, 64 nt, hsa; identical to SEQ ID NO: 138938

SEQ ID NO: 754073 - RNA, 64 nt, hsa; identical to SEQ ID NO: 138939

SEQ ID NO: 754074 - RNA, 64 nt, hsa; identical to SEQ ID NO: 138940

SEQ ID NO: 754075 - RNA, 64 nt, hsa
cucugucacccuacagguguuaacagaacugaaauccgacaaccagaggcugaaagaugaaaau

SEQ ID NO: 754076 - RNA, 64 nt, hsa
uaagagucccacagucuagggagaucugagggcauccgacaaggcccaucuccuucccuccuca

SEQ ID NO: 754077 - RNA, 64 nt, hsa
gagcuuuaguaagcaauugagagaacuguguuuuuccgacaaacggucacauguccaucguuau

SEQ ID NO: 754078 - RNA, 64 nt, hsa
agccuuaugauaucaugcugaggcgccuugcaaauccgacaauuaagauccuccuagaccuuga

SEQ ID NO: 754079 - RNA, 64 nt, hsa
aggagacucauuuuaaccccaguccaguggcuuguccgacaacaggccauuucccuuuacauuc

SEQ ID NO: 754080 - RNA, 64 nt, hsa
uuuuaaaaacuacauugcuucauuacuuucauuuuccgacaacaucaaacuaacaagaggcagu

SEQ ID NO: 754081 - RNA, 64 nt, hsa
uggagguccuguggccacgcggggcaagugccuuuccgacaagacccccggggaaugcaggugc

SEQ ID NO: 754082 - RNA, 64 nt, hsa
gcugaucguuucuuccaguuagagucuucaucuguccgacaaguucacucgccucgguugcgga

SEQ ID NO: 754083 - RNA, 64 nt, hsa
cuaguugcuuuuuauaagaccaagaaggagaaaauccgacaaccuggaaagauuuuuguuuuca

SEQ ID NO: 754084 - RNA, 64 nt, hsa
guacauaccagggaaagaaaggacagcagucaccuccgacaaugcuccguucuauggaauauug

SEQ ID NO: 754085 - RNA, 64 nt, hsa
gcauucugaguguuuacaggcggaccuguucucuuccgacaagcaauuugaaucuuaacuuucc

SEQ ID NO: 754086 - RNA, 64 nt, hsa
ggcugggaguucacagaccucagacacagcugaguccgacaaccauugggguggggcugcauca

SEQ ID NO: 754087 - RNA, 64 nt, hsa
cucccaguacaacaacaugcgcguggaguucaaguccgacaacaccguguccaaaaagggcuuc

SEQ ID NO: 754088 - RNA, 64 nt, hsa
aaacucaauguauaauuuagacgucugucaaaaauccgacaaauaaaauuuagcuggaacgaag

SEQ ID NO: 754089 - RNA, 64 nt, hsa
gaaggaagcccuccuggacugcuucuuuuggcucuccgacaacuccggccaauaaacacuuucu

SEQ ID NO: 754090 - RNA, 64 nt, hsa
ugcauuucgaagauuuuuauacauguuuucuauuuccgacaaugccaggaggcuucauugacgu

SEQ ID NO: 754091 - RNA, 64 nt, hsa
ccauggagacagccgaccggcgacagccuucagcuccgacaaagacacaucaccuugcaaauga

SEQ ID NO: 754092 - RNA, 64 nt, hsa
cuccaggcucuuccugggcccuuagaucugcaguuccgacaagcuuuggcugcaggagguuuua

SEQ ID NO: 754093 - RNA, 64 nt, hsa
uauccucucaaaugcugcuuguuggcuccagucuuccgacaaacuaacaggaacaaaaugaauu

SEQ ID NO: 754094 - RNA, 64 nt, hsa
agcccaaccggggagcccccgccccgccccacauuccgacaaccgaugcuccagccaaccccug

SEQ ID NO: 754095 - RNA, 64 nt, hsa
cauccuccucuucuuucuccuucaucgcuggugcuccgacaaaaaaaguaagucucacgaagca

SEQ ID NO: 754096 - RNA, 64 nt, hsa
gaggugaaggcagagaggagccaggacuguggaguccgacaaagcuacuugaaggacacaagag

SEQ ID NO: 754097 - RNA, 64 nt, hsa
cauagacagcccugggggagccucuuacggaaaauccgacaagccuucagccacagggagccac

SEQ ID NO: 754098 - RNA, 64 nt, hsa
caucacauccuggggcucagaccccugugggagguccgacaaaccuggcgucuauaccaacauc

SEQ ID NO: 754099 - RNA, 64 nt, hsa
caaacccugagcgggcugccggccuccaaguuccuccgacaagaugaugguacuaauuauggua

SEQ ID NO: 754100 - RNA, 64 nt, hsa
ccaccuguggcaaaugcuggagccucaguuaaagugccucaaggggcaaauauuucaccauugc

SEQ ID NO: 754101 - RNA, 64 nt, hsa
ugaggaaaacgaggcaaagagagguuauacaacuugccucaaaucccuugugcacuguaacuca

SEQ ID NO: 754102 - RNA, 64 nt, hsa
acaugggagaaaaagucauccaguuuuucauguuugccucaaguaaucuuuacaguguuacaaa

SEQ ID NO: 754103 - RNA, 64 nt, hsa
agaaguugcuuugcucagugcuuugccccaggauugccucaaaucugaguggacuucauccuuu

SEQ ID NO: 754104 - RNA, 64 nt, hsa
uggaauaugagaggaugggaggcccuuuagaaccugccucaaugccaucucucacucuccuucu

SEQ ID NO: 754105 - RNA, 64 nt, hsa
auugacccuuuuuugccuucucuuucuccuucacugccucaaguuacagccagaggaaaggagg

SEQ ID NO: 754106 - RNA, 64 nt, hsa
cguagcagacaaggggugucugacuggcuucuuuugccucaagaugguguaugucguaagugau

SEQ ID NO: 754107 - RNA, 64 nt, hsa
aauacaaauccuaugaucucuaugcccaauaugcugccucaacucugagcugucugcaaggcuu

SEQ ID NO: 754108 - RNA, 64 nt, hsa
guggccggaugcuuccaacuuugucagucuuuucugccucaacuucuuccagacaucagucacc

SEQ ID NO: 754109 - RNA, 64 nt, hsa
caagaaccuguauauguguuguguuagaggcaucugccucaagucuauguacaguguuugcugc

SEQ ID NO: 754110 - RNA, 64 nt, hsa
gccucaaguccaggcaaguuacaaugccuuguugugccucaauaaaaaaguuacaugcaccuuc

SEQ ID NO: 754111 - RNA, 64 nt, hsa
uuaacuguauuaacguucagcuuacuaaacugacugccucaaguccaggcaaguuacaaugccu

SEQ ID NO: 754112 - RNA, 64 nt, hsa
agagagguuuuagauuuuuguuuuuuuuuuguucugccucaaagcucaguuuauugaagacauu

SEQ ID NO: 754113 - RNA, 64 nt, hsa
cugcucuccuaugaccccaaaucauagucaauggugccucaaacauagcaccuuaaguuaaagg

SEQ ID NO: 754114 - RNA, 64 nt, hsa
gaaaucuauauaugagaaacguuuggauaauauuugccucaaggauuguuuaccuaaaacagaa

SEQ ID NO: 754115 - RNA, 64 nt, hsa
cuuuccauguaccucuggugugucagggauuuugugccucaaaaaauguuuccaagguugugug

SEQ ID NO: 754116 - RNA, 64 nt, hsa; identical to SEQ ID NO: 687969

SEQ ID NO: 754117 - RNA, 64 nt, hsa; identical to SEQ ID NO: 687970

SEQ ID NO: 754118 - RNA, 64 nt, hsa; identical to SEQ ID NO: 687971

SEQ ID NO: 754119 - RNA, 64 nt, hsa; identical to SEQ ID NO: 687972

SEQ ID NO: 754120 - RNA, 64 nt, hsa; identical to SEQ ID NO: 687973

SEQ ID NO: 754121 - RNA, 64 nt, hsa; identical to SEQ ID NO: 687974

SEQ ID NO: 754122 - RNA, 64 nt, hsa; identical to SEQ ID NO: 266194

SEQ ID NO: 754123 - RNA, 64 nt, hsa; identical to SEQ ID NO: 266195

SEQ ID NO: 754124 - RNA, 64 nt, hsa; identical to SEQ ID NO: 266196

SEQ ID NO: 754125 - RNA, 64 nt, hsa; identical to SEQ ID NO: 266197

SEQ ID NO: 754126 - RNA, 64 nt, hsa; identical to SEQ ID NO: 266198

SEQ ID NO: 754127 - RNA, 64 nt, hsa; identical to SEQ ID NO: 266199

SEQ ID NO: 754128 - RNA, 64 nt, hsa; identical to SEQ ID NO: 266200

SEQ ID NO: 754129 - RNA, 64 nt, hsa; identical to SEQ ID NO: 266201

SEQ ID NO: 754130 - RNA, 64 nt, hsa; identical to SEQ ID NO: 266202

SEQ ID NO: 754131 - RNA, 64 nt, hsa; identical to SEQ ID NO: 266203

SEQ ID NO: 754132 - RNA, 64 nt, hsa; identical to SEQ ID NO: 266204

SEQ ID NO: 754133 - RNA, 64 nt, hsa; identical to SEQ ID NO: 266205

SEQ ID NO: 754134 - RNA, 64 nt, hsa; identical to SEQ ID NO: 266206

SEQ ID NO: 754135 - RNA, 64 nt, hsa; identical to SEQ ID NO: 266207

SEQ ID NO: 754136 - RNA, 64 nt, hsa; identical to SEQ ID NO: 266208

SEQ ID NO: 754137 - RNA, 64 nt, hsa; identical to SEQ ID NO: 266209

SEQ ID NO: 754138 - RNA, 64 nt, hsa; identical to SEQ ID NO: 266210

SEQ ID NO: 754139 - RNA, 64 nt, hsa; identical to SEQ ID NO: 266211

SEQ ID NO: 754140 - RNA, 64 nt, hsa; identical to SEQ ID NO: 266212

SEQ ID NO: 754141 - RNA, 64 nt, hsa; identical to SEQ ID NO: 266213

SEQ ID NO: 754142 - RNA, 64 nt, hsa; identical to SEQ ID NO: 266214

SEQ ID NO: 754143 - RNA, 64 nt, hsa; identical to SEQ ID NO: 266215

SEQ ID NO: 754144 - RNA, 64 nt, hsa; identical to SEQ ID NO: 266216

SEQ ID NO: 754145 - RNA, 64 nt, hsa; identical to SEQ ID NO: 266217

SEQ ID NO: 754146 - RNA, 64 nt, hsa; identical to SEQ ID NO: 266218

SEQ ID NO: 754147 - RNA, 64 nt, hsa; identical to SEQ ID NO: 266219

SEQ ID NO: 754148 - RNA, 64 nt, hsa; identical to SEQ ID NO: 266220

SEQ ID NO: 754149 - RNA, 64 nt, hsa; identical to SEQ ID NO: 266221

SEQ ID NO: 754150 - RNA, 64 nt, hsa; identical to SEQ ID NO: 266222

SEQ ID NO: 754151 - RNA, 64 nt, hsa; identical to SEQ ID NO: 266223

SEQ ID NO: 754152 - RNA, 64 nt, hsa; identical to SEQ ID NO: 266224

SEQ ID NO: 754153 - RNA, 64 nt, hsa; identical to SEQ ID NO: 266225

SEQ ID NO: 754154 - RNA, 64 nt, hsa; identical to SEQ ID NO: 266226

SEQ ID NO: 754155 - RNA, 64 nt, hsa; identical to SEQ ID NO: 266227

SEQ ID NO: 754156 - RNA, 64 nt, hsa; identical to SEQ ID NO: 266228

SEQ ID NO: 754157 - RNA, 64 nt, hsa; identical to SEQ ID NO: 266229

SEQ ID NO: 754158 - RNA, 64 nt, hsa; identical to SEQ ID NO: 266230

SEQ ID NO: 754159 - RNA, 64 nt, hsa; identical to SEQ ID NO: 266231

SEQ ID NO: 754160 - RNA, 64 nt, hsa; identical to SEQ ID NO: 266232

SEQ ID NO: 754161 - RNA, 64 nt, hsa; identical to SEQ ID NO: 266233

SEQ ID NO: 754162 - RNA, 64 nt, hsa; identical to SEQ ID NO: 266234

SEQ ID NO: 754163 - RNA, 64 nt, hsa; identical to SEQ ID NO: 266235

SEQ ID NO: 754164 - RNA, 64 nt, hsa; identical to SEQ ID NO: 266236

SEQ ID NO: 754165 - RNA, 64 nt, hsa; identical to SEQ ID NO: 266237

SEQ ID NO: 754166 - RNA, 64 nt, hsa; identical to SEQ ID NO: 266238

SEQ ID NO: 754167 - RNA, 64 nt, hsa; identical to SEQ ID NO: 266239

SEQ ID NO: 754168 - RNA, 64 nt, hsa; identical to SEQ ID NO: 266240

SEQ ID NO: 754169 - RNA, 64 nt, hsa; identical to SEQ ID NO: 266241

SEQ ID NO: 754170 - RNA, 64 nt, hsa; identical to SEQ ID NO: 266242

SEQ ID NO: 754171 - RNA, 64 nt, hsa; identical to SEQ ID NO: 266243

SEQ ID NO: 754172 - RNA, 64 nt, hsa; identical to SEQ ID NO: 266244

SEQ ID NO: 754173 - RNA, 64 nt, hsa; identical to SEQ ID NO: 266245

SEQ ID NO: 754174 - RNA, 64 nt, hsa; identical to SEQ ID NO: 266246

SEQ ID NO: 754175 - RNA, 64 nt, hsa; identical to SEQ ID NO: 266247

SEQ ID NO: 754176 - RNA, 64 nt, hsa; identical to SEQ ID NO: 266248

SEQ ID NO: 754177 - RNA, 64 nt, hsa; identical to SEQ ID NO: 266249

SEQ ID NO: 754178 - RNA, 64 nt, hsa; identical to SEQ ID NO: 266250

SEQ ID NO: 754179 - RNA, 64 nt, hsa; identical to SEQ ID NO: 266251

SEQ ID NO: 754180 - RNA, 64 nt, hsa; identical to SEQ ID NO: 266252

SEQ ID NO: 754181 - RNA, 64 nt, hsa; identical to SEQ ID NO: 235460

SEQ ID NO: 754182 - RNA, 64 nt, hsa; identical to SEQ ID NO: 235461

SEQ ID NO: 754183 - RNA, 64 nt, hsa; identical to SEQ ID NO: 235462

SEQ ID NO: 754184 - RNA, 64 nt, hsa; identical to SEQ ID NO: 235463

SEQ ID NO: 754185 - RNA, 64 nt, hsa; identical to SEQ ID NO: 235464

SEQ ID NO: 754186 - RNA, 64 nt, hsa; identical to SEQ ID NO: 235465

SEQ ID NO: 754187 - RNA, 64 nt, hsa; identical to SEQ ID NO: 235466

SEQ ID NO: 754188 - RNA, 64 nt, hsa; identical to SEQ ID NO: 235467

SEQ ID NO: 754189 - RNA, 64 nt, hsa; identical to SEQ ID NO: 235468

SEQ ID NO: 754190 - RNA, 64 nt, hsa; identical to SEQ ID NO: 235469

SEQ ID NO: 754191 - RNA, 64 nt, hsa; identical to SEQ ID NO: 235470

SEQ ID NO: 754192 - RNA, 64 nt, hsa; identical to SEQ ID NO: 235471

SEQ ID NO: 754193 - RNA, 64 nt, hsa; identical to SEQ ID NO: 235472

SEQ ID NO: 754194 - RNA, 64 nt, hsa; identical to SEQ ID NO: 235473

SEQ ID NO: 754195 - RNA, 64 nt, hsa; identical to SEQ ID NO: 235474

SEQ ID NO: 754196 - RNA, 64 nt, hsa; identical to SEQ ID NO: 235475

SEQ ID NO: 754197 - RNA, 64 nt, hsa; identical to SEQ ID NO: 235476

SEQ ID NO: 754198 - RNA, 64 nt, hsa; identical to SEQ ID NO: 235477

SEQ ID NO: 754199 - RNA, 64 nt, hsa; identical to SEQ ID NO: 235478

SEQ ID NO: 754200 - RNA, 64 nt, hsa; identical to SEQ ID NO: 235479

SEQ ID NO: 754201 - RNA, 64 nt, hsa; identical to SEQ ID NO: 235480

SEQ ID NO: 754202 - RNA, 64 nt, hsa; identical to SEQ ID NO: 235481

SEQ ID NO: 754203 - RNA, 64 nt, hsa; identical to SEQ ID NO: 235482

SEQ ID NO: 754204 - RNA, 64 nt, hsa; identical to SEQ ID NO: 235483

SEQ ID NO: 754205 - RNA, 64 nt, hsa; identical to SEQ ID NO: 235484

SEQ ID NO: 754206 - RNA, 64 nt, hsa; identical to SEQ ID NO: 235485

SEQ ID NO: 754207 - RNA, 64 nt, hsa; identical to SEQ ID NO: 235486

SEQ ID NO: 754208 - RNA, 64 nt, hsa; identical to SEQ ID NO: 235487

SEQ ID NO: 754209 - RNA, 64 nt, hsa; identical to SEQ ID NO: 235488

SEQ ID NO: 754210 - RNA, 64 nt, hsa; identical to SEQ ID NO: 235489

SEQ ID NO: 754211 - RNA, 64 nt, hsa; identical to SEQ ID NO: 235490

SEQ ID NO: 754212 - RNA, 64 nt, hsa; identical to SEQ ID NO: 235491

SEQ ID NO: 754213 - RNA, 64 nt, hsa; identical to SEQ ID NO: 235492

SEQ ID NO: 754214 - RNA, 64 nt, hsa; identical to SEQ ID NO: 235493

SEQ ID NO: 754215 - RNA, 64 nt, hsa; identical to SEQ ID NO: 235494

SEQ ID NO: 754216 - RNA, 64 nt, hsa; identical to SEQ ID NO: 235495

SEQ ID NO: 754217 - RNA, 64 nt, hsa; identical to SEQ ID NO: 235496

SEQ ID NO: 754218 - RNA, 64 nt, hsa; identical to SEQ ID NO: 235497

SEQ ID NO: 754219 - RNA, 64 nt, hsa; identical to SEQ ID NO: 235498

SEQ ID NO: 754220 - RNA, 64 nt, hsa; identical to SEQ ID NO: 235499

SEQ ID NO: 754221 - RNA, 64 nt, hsa; identical to SEQ ID NO: 235500

SEQ ID NO: 754222 - RNA, 64 nt, hsa; identical to SEQ ID NO: 235501

SEQ ID NO: 754223 - RNA, 64 nt, hsa; identical to SEQ ID NO: 235502

SEQ ID NO: 754224 - RNA, 64 nt, hsa; identical to SEQ ID NO: 235503

SEQ ID NO: 754225 - RNA, 64 nt, hsa; identical to SEQ ID NO: 235504

SEQ ID NO: 754226 - RNA, 64 nt, hsa; identical to SEQ ID NO: 235505

SEQ ID NO: 754227 - RNA, 64 nt, hsa; identical to SEQ ID NO: 235506

SEQ ID NO: 754228 - RNA, 64 nt, hsa; identical to SEQ ID NO: 235507

SEQ ID NO: 754229 - RNA, 64 nt, hsa; identical to SEQ ID NO: 235508

SEQ ID NO: 754230 - RNA, 64 nt, hsa; identical to SEQ ID NO: 235509

SEQ ID NO: 754231 - RNA, 64 nt, hsa; identical to SEQ ID NO: 235510

SEQ ID NO: 754232 - RNA, 64 nt, hsa; identical to SEQ ID NO: 235511

SEQ ID NO: 754233 - RNA, 64 nt, hsa; identical to SEQ ID NO: 235512

SEQ ID NO: 754234 - RNA, 64 nt, hsa; identical to SEQ ID NO: 235513

SEQ ID NO: 754235 - RNA, 64 nt, hsa; identical to SEQ ID NO: 235514

SEQ ID NO: 754236 - RNA, 64 nt, hsa; identical to SEQ ID NO: 235515

SEQ ID NO: 754237 - RNA, 64 nt, hsa; identical to SEQ ID NO: 235516

SEQ ID NO: 754238 - RNA, 64 nt, hsa; identical to SEQ ID NO: 235517

SEQ ID NO: 754239 - RNA, 64 nt, hsa; identical to SEQ ID NO: 235518

SEQ ID NO: 754240 - RNA, 64 nt, hsa; identical to SEQ ID NO: 235519

SEQ ID NO: 754241 - RNA, 64 nt, hsa; identical to SEQ ID NO: 235520

SEQ ID NO: 754242 - RNA, 64 nt, hsa; identical to SEQ ID NO: 235521

SEQ ID NO: 754243 - RNA, 64 nt, hsa; identical to SEQ ID NO: 235522

SEQ ID NO: 754244 - RNA, 64 nt, hsa; identical to SEQ ID NO: 235523

SEQ ID NO: 754245 - RNA, 64 nt, hsa; identical to SEQ ID NO: 235524

SEQ ID NO: 754246 - RNA, 64 nt, hsa; identical to SEQ ID NO: 235525

SEQ ID NO: 754247 - RNA, 64 nt, hsa; identical to SEQ ID NO: 235526

SEQ ID NO: 754248 - RNA, 64 nt, hsa; identical to SEQ ID NO: 235527

SEQ ID NO: 754249 - RNA, 64 nt, hsa; identical to SEQ ID NO: 235528

SEQ ID NO: 754250 - RNA, 64 nt, hsa; identical to SEQ ID NO: 235529

SEQ ID NO: 754251 - RNA, 64 nt, hsa; identical to SEQ ID NO: 235530

SEQ ID NO: 754252 - RNA, 64 nt, hsa; identical to SEQ ID NO: 235531

SEQ ID NO: 754253 - RNA, 64 nt, hsa; identical to SEQ ID NO: 235532

SEQ ID NO: 754254 - RNA, 64 nt, hsa; identical to SEQ ID NO: 235533

SEQ ID NO: 754255 - RNA, 64 nt, hsa; identical to SEQ ID NO: 235534

SEQ ID NO: 754256 - RNA, 64 nt, hsa; identical to SEQ ID NO: 235535

SEQ ID NO: 754257 - RNA, 64 nt, hsa; identical to SEQ ID NO: 235536

SEQ ID NO: 754258 - RNA, 64 nt, hsa; identical to SEQ ID NO: 235537

SEQ ID NO: 754259 - RNA, 64 nt, hsa; identical to SEQ ID NO: 235538

SEQ ID NO: 754260 - RNA, 64 nt, hsa; identical to SEQ ID NO: 235539

SEQ ID NO: 754261 - RNA, 64 nt, hsa; identical to SEQ ID NO: 235540

SEQ ID NO: 754262 - RNA, 64 nt, hsa; identical to SEQ ID NO: 235541

SEQ ID NO: 754263 - RNA, 64 nt, hsa; identical to SEQ ID NO: 235542

SEQ ID NO: 754264 - RNA, 64 nt, hsa; identical to SEQ ID NO: 235543

SEQ ID NO: 754265 - RNA, 64 nt, hsa; identical to SEQ ID NO: 235544

SEQ ID NO: 754266 - RNA, 64 nt, hsa; identical to SEQ ID NO: 235545

SEQ ID NO: 754267 - RNA, 64 nt, hsa; identical to SEQ ID NO: 235546

SEQ ID NO: 754268 - RNA, 64 nt, hsa; identical to SEQ ID NO: 235547

SEQ ID NO: 754269 - RNA, 64 nt, hsa; identical to SEQ ID NO: 235548

SEQ ID NO: 754270 - RNA, 64 nt, hsa; identical to SEQ ID NO: 235549

SEQ ID NO: 754271 - RNA, 64 nt, hsa; identical to SEQ ID NO: 235550

SEQ ID NO: 754272 - RNA, 64 nt, hsa; identical to SEQ ID NO: 235551

SEQ ID NO: 754273 - RNA, 64 nt, hsa; identical to SEQ ID NO: 235552

SEQ ID NO: 754274 - RNA, 64 nt, hsa; identical to SEQ ID NO: 235553

SEQ ID NO: 754275 - RNA, 64 nt, hsa; identical to SEQ ID NO: 235554

SEQ ID NO: 754276 - RNA, 64 nt, hsa; identical to SEQ ID NO: 235555

SEQ ID NO: 754277 - RNA, 64 nt, hsa; identical to SEQ ID NO: 235556

SEQ ID NO: 754278 - RNA, 64 nt, hsa; identical to SEQ ID NO: 235557

SEQ ID NO: 754279 - RNA, 64 nt, hsa; identical to SEQ ID NO: 235558

SEQ ID NO: 754280 - RNA, 64 nt, hsa; identical to SEQ ID NO: 235559

SEQ ID NO: 754281 - RNA, 64 nt, hsa; identical to SEQ ID NO: 235560

SEQ ID NO: 754282 - RNA, 64 nt, hsa; identical to SEQ ID NO: 235561

SEQ ID NO: 754283 - RNA, 64 nt, hsa; identical to SEQ ID NO: 235562

SEQ ID NO: 754284 - RNA, 64 nt, hsa; identical to SEQ ID NO: 235563

SEQ ID NO: 754285 - RNA, 64 nt, hsa; identical to SEQ ID NO: 235564

SEQ ID NO: 754286 - RNA, 64 nt, hsa; identical to SEQ ID NO: 235565

SEQ ID NO: 754287 - RNA, 64 nt, hsa; identical to SEQ ID NO: 235566

SEQ ID NO: 754288 - RNA, 64 nt, hsa; identical to SEQ ID NO: 235567

SEQ ID NO: 754289 - RNA, 64 nt, hsa; identical to SEQ ID NO: 235568

SEQ ID NO: 754290 - RNA, 64 nt, hsa; identical to SEQ ID NO: 235569

SEQ ID NO: 754291 - RNA, 64 nt, hsa; identical to SEQ ID NO: 235570

SEQ ID NO: 754292 - RNA, 64 nt, hsa; identical to SEQ ID NO: 235571

SEQ ID NO: 754293 - RNA, 64 nt, hsa; identical to SEQ ID NO: 235572

SEQ ID NO: 754294 - RNA, 64 nt, hsa; identical to SEQ ID NO: 235573

SEQ ID NO: 754295 - RNA, 64 nt, hsa; identical to SEQ ID NO: 235574

SEQ ID NO: 754296 - RNA, 64 nt, hsa; identical to SEQ ID NO: 235575

SEQ ID NO: 754297 - RNA, 64 nt, hsa; identical to SEQ ID NO: 235576

SEQ ID NO: 754298 - RNA, 64 nt, hsa; identical to SEQ ID NO: 235577

SEQ ID NO: 754299 - RNA, 64 nt, hsa; identical to SEQ ID NO: 235578

SEQ ID NO: 754300 - RNA, 64 nt, hsa; identical to SEQ ID NO: 235579

SEQ ID NO: 754301 - RNA, 64 nt, hsa; identical to SEQ ID NO: 235580

SEQ ID NO: 754302 - RNA, 64 nt, hsa; identical to SEQ ID NO: 235581

SEQ ID NO: 754303 - RNA, 64 nt, hsa; identical to SEQ ID NO: 235582

SEQ ID NO: 754304 - RNA, 64 nt, hsa; identical to SEQ ID NO: 235583

SEQ ID NO: 754305 - RNA, 64 nt, hsa; identical to SEQ ID NO: 235584

SEQ ID NO: 754306 - RNA, 64 nt, hsa; identical to SEQ ID NO: 235585

SEQ ID NO: 754307 - RNA, 64 nt, hsa; identical to SEQ ID NO: 235586

SEQ ID NO: 754308 - RNA, 64 nt, hsa; identical to SEQ ID NO: 235587

SEQ ID NO: 754309 - RNA, 64 nt, hsa; identical to SEQ ID NO: 235588

SEQ ID NO: 754310 - RNA, 64 nt, hsa; identical to SEQ ID NO: 235589

SEQ ID NO: 754311 - RNA, 64 nt, hsa; identical to SEQ ID NO: 235590

SEQ ID NO: 754312 - RNA, 64 nt, hsa; identical to SEQ ID NO: 235591

SEQ ID NO: 754313 - RNA, 54 nt, hsa; identical to SEQ ID NO: 235592

SEQ ID NO: 754314 - RNA, 64 nt, hsa; identical to SEQ ID NO: 235593

SEQ ID NO: 754315 - RNA, 64 nt, hsa; identical to SEQ ID NO: 235594

SEQ ID NO: 754316 - RNA, 64 nt, hsa; identical to SEQ ID NO: 235595

SEQ ID NO: 754317 - RNA, 64 nt, hsa; identical to SEQ ID NO: 235596

SEQ ID NO: 754318 - RNA, 64 nt, hsa; identical to SEQ ID NO: 235597

SEQ ID NO: 754319 - RNA, 64 nt, hsa; identical to SEQ ID NO: 235598

SEQ ID NO: 754320 - RNA, 64 nt, hsa; identical to SEQ ID NO: 235599

SEQ ID NO: 754321 - RNA, 64 nt, hsa; identical to SEQ ID NO: 235600

SEQ ID NO: 754322 - RNA, 64 nt, hsa; identical to SEQ ID NO: 235601

SEQ ID NO: 754323 - RNA, 64 nt, hsa; identical to SEQ ID NO: 235602

SEQ ID NO: 754324 - RNA, 64 nt, hsa; identical to SEQ ID NO: 235603

SEQ ID NO: 754325 - RNA, 64 nt, hsa; identical to SEQ ID NO: 235604

SEQ ID NO: 754326 - RNA, 64 nt, hsa; identical to SEQ ID NO: 235605

SEQ ID NO: 754327 - RNA, 64 nt, hsa; identical to SEQ ID NO: 235606

SEQ ID NO: 754328 - RNA, 64 nt, hsa; identical to SEQ ID NO: 235607

SEQ ID NO: 754329 - RNA, 64 nt, hsa; identical to SEQ ID NO: 235608

SEQ ID NO: 754330 - RNA, 64 nt, hsa; identical to SEQ ID NO: 235609

SEQ ID NO: 754331 - RNA, 64 nt, hsa; identical to SEQ ID NO: 235610

SEQ ID NO: 754332 - RNA, 64 nt, hsa; identical to SEQ ID NO: 235611

SEQ ID NO: 754333 - RNA, 64 nt, hsa; identical to SEQ ID NO: 235612

SEQ ID NO: 754334 - RNA, 64 nt, hsa; identical to SEQ ID NO: 235613

SEQ ID NO: 754335 - RNA, 64 nt, hsa; identical to SEQ ID NO: 235614

SEQ ID NO: 754336 - RNA, 64 nt, hsa; identical to SEQ ID NO: 235615

SEQ ID NO: 754337 - RNA, 64 nt, hsa; identical to SEQ ID NO: 235616

SEQ ID NO: 754338 - RNA, 63 nt, hsa
agugguuaauagaguuuacagugagcuugccuuaggauggaccagcaagcccccguggacccu

SEQ ID NO: 754339 - RNA, 63 nt, hsa
ucuguguagauagagauggugucaaggaggugcaggauggagaugggagauuucauggagccu

SEQ ID NO: 754340 - RNA, 63 nt, hsa
cccccugcguguguauauuggugggaggcauagaggauggauguucuagaaaugaguaagaca

SEQ ID NO: 754341 - RNA, 63 nt, hsa
cggucacaugccagguccccagcuacgcauucaaggauggauaauauacauagcagcacaucc

SEQ ID NO: 754342 - RNA, 63 nt, hsa
cagauucugcuuugaauauagcuacagaaauaaaggauggacuacagugugggacagguaauu

SEQ ID NO: 754343 - RNA, 63 nt, hsa
aagacucuguuucgaauauagccacagaaauaaaggauggagaaaaaucugggacagguaauu

SEQ ID NO: 754344 - RNA, 63 nt, hsa
aagauucuguuucgaacauagccacagaaauaaaggauggagaaaaaucugggacagguaauu

SEQ ID NO: 754345 - RNA, 63 nt, hsa
aagguucuguuuugaguauagccagagaaaacaaggauggagaaaaaucuaggacagguaauu

SEQ ID NO: 754346 - RNA, 63 nt, hsa
aggauucuuuuucgaauauaaccagaggaaaaaaggauggagaaauaucuaggaaagguaauu

SEQ ID NO: 754347 - RNA, 63 nt, hsa
aggauucuuuuucgaauauaaccagagaaaaaaaggauggagaaauaucuaggaaagguaauu

SEQ ID NO: 754348 - RNA, 63 nt, hsa
aagauucuguuuuggguauagccagagaaaacaaggauggagaaaaaucuaggacagguaauu

SEQ ID NO: 754349 - RNA, 63 nt, hsa
uccacguugccuucugcgcaaaggguuucaccaaggauggagaaagggagacagcuugcagau

SEQ ID NO: 754350 - RNA, 63 nt, hsa
aaacacaaaacauaauaaaacaccaagaacaugaggauggagagaaguaucagcacccagaag

SEQ ID NO: 754351 - RNA, 63 nt, hsa
uucuggccagucccugcauccucccugggguggaggauggaaggaaagcugggacaagcaggg

SEQ ID NO: 754352 - RNA, 63 nt, hsa
auguggcaaucaaugacacuauugggguuucccaggauggauuggucagggggagaaaggaaa

SEQ ID NO: 754353 - RNA, 63 nt, hsa
cacuaaaaaagaagguuucuaaauuguaggagcaggauggaaauacuuugcugcccuugccau

SEQ ID NO: 754354 - RNA, 63 nt, hsa
uauagacaaggcugagcaggguuccuguggcccaggauggaggccaccgcugcccugccaucc

SEQ ID NO: 754355 - RNA, 63 nt, hsa
uuggggagagaaggauggagauaggauggagauaggauggagauguggcucuucucaucuuug

SEQ ID NO: 754356 - RNA, 63 nt, hsa
accacacgcuguuggggagagaaggauggagauaggauggagauaggauggagauguggcucu

SEQ ID NO: 754357 - RNA, 63 nt, hsa
ugaaacagacaaccacacgcuguuggggagagaaggauggagauaggauggagauaggaugga

SEQ ID NO: 754358 - RNA, 63 nt, hsa
agaaaguuaucaagagaaagaggugaggauggaaggauggagaaaaacagacugugggaagga

SEQ ID NO: 754359 - RNA, 63 nt, hsa
uugggaagagaaaguuaucaagagaaagaggugaggauggaaggauggagaaaaacagacugu

SEQ ID NO: 754360 - RNA, 63 nt, hsa
cauggucaguugugagcauuuugguuuccgcaaaggauggauggugagcaucaugggaaagcu

SEQ ID NO: 754361 - RNA, 63 nt, hsa
uauuggcccagcaaggcaaagaacugaaguuccaggauggaagaaccuguguucuccucauaa

SEQ ID NO: 754362 - RNA, 63 nt, hsa
ucgaguuuuucaaauugugagggggaccauaaaaggauggaaacuuuuagaugacauucuaca

SEQ ID NO: 754363 - RNA, 63 nt, hsa
uaauguauuguaucaaauugugaauaagaaaguaggauggagcuuucuagagguugggccuua

SEQ ID NO: 754364 - RNA, 63 nt, hsa
ccuauuugcuuaaaaguacaggcucccuaagagaggauggagagggagagacugaauuguuag

SEQ ID NO: 754365 - RNA, 63 nt, hsa
cauauuccaaaacccuucuuuuuaaaaggaaaaaggauggagagaaggauggaaagccuggac

SEQ ID NO: 754366 - RNA, 63 nt, hsa
cccuucuuuuuaaaaggaaaaaggauggagagaaggauggaaagccuggacuuaaaccuuuag

SEQ ID NO: 754367 - RNA, 63 nt, hsa
uccuuagcccgucacuccauacaguauuaggugaggauggaugcgggcgcuguccuugccggg

SEQ ID NO: 754368 - RNA, 63 nt, hsa
guuccugggccuggcgggggaggcaggggugagaggauggaauugugugcacaagaacugugg

SEQ ID NO: 754369 - RNA, 63 nt, hsa
ucacuauggcaugcuucccuccuggugggcccuaggauggaugacacucaagauacuacagau

SEQ ID NO: 754370 - RNA, 63 nt, hsa
aucucuacuuggaucaauucuggucauuucaagaggauggaggccucaagugugggaacuucc

SEQ ID NO: 754371 - RNA, 63 nt, hsa
cuuuguacugcucucugggagccucccugcuugaggauggaaggaugaaauuugacgaauaua

SEQ ID NO: 754372 - RNA, 63 nt, hsa
aaagccggggaccaucuguauugcuuuguuuuuaggauggagaaugucagaucaaguuagaaa

SEQ ID NO: 754373 - RNA, 63 nt, hsa
augagaaggcccgucugcagcaccaggucacugaggauggagaguucuggugaguccagaacc

SEQ ID NO: 754374 - RNA, 63 nt, hsa
auucuuucacaggagcuuuucaugcauuugacaaggauggagaugguaucaucaagcucaacg

SEQ ID NO: 754375 - RNA, 63 nt, hsa
auggagagcucugauuccuacauaauaugaauaaggauggauaggccgggcgugguggcucau

SEQ ID NO: 754376 - RNA, 63 nt, hsa
aacagagcgagaccccgacucaauaaauaaauaaggauggauaaauuguagcguaugcaccau

SEQ ID NO: 754377 - RNA, 63 nt, hsa
guuucuguugacccccaccuuccaguguuggacaggauggaggggggacacuugcuuaggggc

SEQ ID NO: 754378 - RNA, 63 nt, hsa
acagaaccaacauugugacgcccagguugcaacaggauggaauucagggacggacccagccug

SEQ ID NO: 754379 - RNA, 64 nt, hsa; identical to SEQ ID NO: 168029

SEQ ID NO: 754380 - RNA, 64 nt, hsa; identical to SEQ ID NO: 168030

SEQ ID NO: 754381 - RNA, 64 nt, hsa; identical to SEQ ID NO: 168031

SEQ ID NO: 754382 - RNA, 64 nt, hsa; identical to SEQ ID NO: 168032

SEQ ID NO: 754383 - RNA, 64 nt, hsa; identical to SEQ ID NO: 168033

SEQ ID NO: 754384 - RNA, 64 nt, hsa; identical to SEQ ID NO: 168034

SEQ ID NO: 754385 - RNA, 64 nt, hsa; identical to SEQ ID NO: 168035

SEQ ID NO: 754386 - RNA, 64 nt, hsa; identical to SEQ ID NO: 168036

SEQ ID NO: 754387 - RNA, 64 nt, hsa; identical to SEQ ID NO: 168037

SEQ ID NO: 754388 - RNA, 64 nt, hsa; identical to SEQ ID NO: 168038

SEQ ID NO: 754389 - RNA, 64 nt, hsa; identical to SEQ ID NO: 168039

SEQ ID NO: 754390 - RNA, 64 nt, hsa; identical to SEQ ID NO: 168040

SEQ ID NO: 754391 - RNA, 64 nt, hsa; identical to SEQ ID NO: 168041

SEQ ID NO: 754392 - RNA, 64 nt, hsa; identical to SEQ ID NO: 168042

SEQ ID NO: 754393 - RNA, 64 nt, hsa; identical to SEQ ID NO: 168043

SEQ ID NO: 754394 - RNA, 64 nt, hsa; identical to SEQ ID NO: 168044

SEQ ID NO: 754395 - RNA, 64 nt, hsa; identical to SEQ ID NO: 168045

SEQ ID NO: 754396 - RNA, 64 nt, hsa; identical to SEQ ID NO: 168046

SEQ ID NO: 754397 - RNA, 64 nt, hsa; identical to SEQ ID NO: 168047

SEQ ID NO: 754398 - RNA, 64 nt, hsa; identical to SEQ ID NO: 168048

SEQ ID NO: 754399 - RNA, 64 nt, hsa; identical to SEQ ID NO: 168049

SEQ ID NO: 754400 - RNA, 64 nt, hsa; identical to SEQ ID NO: 168050

SEQ ID NO: 754401 - RNA, 64 nt, hsa; identical to SEQ ID NO: 168051

SEQ ID NO: 754402 - RNA, 64 nt, hsa; identical to SEQ ID NO: 168052

SEQ ID NO: 754403 - RNA, 64 nt, hsa; identical to SEQ ID NO: 168053

SEQ ID NO: 754404 - RNA, 64 nt, hsa; identical to SEQ ID NO: 168054

SEQ ID NO: 754405 - RNA, 64 nt, hsa; identical to SEQ ID NO: 168055

SEQ ID NO: 754406 - RNA, 64 nt, hsa; identical to SEQ ID NO: 168056

SEQ ID NO: 754407 - RNA, 64 nt, hsa; identical to SEQ ID NO: 168057

SEQ ID NO: 754408 - RNA, 64 nt, hsa; identical to SEQ ID NO: 168058

SEQ ID NO: 754409 - RNA, 64 nt, hsa; identical to SEQ ID NO: 168059

SEQ ID NO: 754410 - RNA, 64 nt, hsa; identical to SEQ ID NO: 168060

SEQ ID NO: 754411 - RNA, 64 nt, hsa; identical to SEQ ID NO: 168061

SEQ ID NO: 754412 - RNA, 64 nt, hsa; identical to SEQ ID NO: 168062

SEQ ID NO: 754413 - RNA, 64 nt, hsa; identical to SEQ ID NO: 168063

SEQ ID NO: 754414 - RNA, 64 nt, hsa; identical to SEQ ID NO: 168064

SEQ ID NO: 754415 - RNA, 64 nt, hsa; identical to SEQ ID NO: 168065

SEQ ID NO: 754416 - RNA, 64 nt, hsa; identical to SEQ ID NO: 168066

SEQ ID NO: 754417 - RNA, 64 nt, hsa
cauuccuuugaauacgcuaauaagugacaaauaagauuaauaagauuuuucaaaaucgccagga

SEQ ID NO: 754418 - RNA, 64 nt, hsa
uacauuugguuauguugauaaaccaaaaacauuugauuaauaaaauaucuauuugaauaaauua

SEQ ID NO: 754419 - RNA, 64 nt, hsa
cccaauuuauauuuuaaaaagcuaaagaacacuggauuaauaaucuuuugggaggguagaauaa

SEQ ID NO: 754420 - RNA, 64 nt, hsa
auacuggaccaucauuaaauguguacugugaagagauuaauauguaugaagggcuuuaccaaag

SEQ ID NO: 754421 - RNA, 64 nt, hsa
uccgcccacccugacagagaacaagcuggagaagaacgaggaggcggcccugcuauccugggag

SEQ ID NO: 754422 - RNA, 64 nt, hsa
cacgcuguaccccauggucacgcgguggaggcggaacgaggauggagccaucugcaggaagagc

SEQ ID NO: 754423 - RNA, 62 nt, hsa
cuuucugggguccugaguggcuuccaggagagcgggaugaacccuggaccuggaguaggaga

SEQ ID NO: 754424 - RNA, 62 nt, hsa
uuuuuuucccacuaagcaaggggcccugaccucgggaugagauaacaaauuguaauaaagua

SEQ ID NO: 754425 - RNA, 62 nt, hsa
acacauauuagcucauucaguccccagacagacgggaugaaguagguauuguuacuguuccc

SEQ ID NO: 754426 - RNA, 62 nt, hsa
gccuggguguugggguucugaucagaauuuggcgggaugauauguuugccauuuucucacug

SEQ ID NO: 754427 - RNA, 62 nt, hsa
ugucagggggauuggguugaaaacuggccagucgggaugacugggugaaagaggaguagcuc

SEQ ID NO: 754428 - RNA, 62 nt, hsa
uauacacacacacagacacacacacacacacacgggaugaauggagccuuaaagaguuagga

SEQ ID NO: 754429 - RNA, 62 nt, hsa
aggagaguucaagugaugagcagacgccuagucgggaugaugauagccaguccaggagucca

SEQ ID NO: 754430 - RNA, 62 nt, hsa
ucuuguaccaggcaggggugccucacugugagcgggaugacuguucacugccacuguccugu

SEQ ID NO: 754431 - RNA, 62 nt, hsa
cccccagcgcuuagaaacauguuccuguuccucgggaugaaaagccauaucuagucaauaac

SEQ ID NO: 754432 - RNA, 62 nt, hsa
ucguacugaaaaagcaacauacugugaugauacgggaugacaucauuucagguugggcauac

SEQ ID NO: 754433 - RNA, 62 nt, hsa
gucuguauccagacaucuaugugcuuggacaacgggaugaaaagacaugaaaaaccacacug

SEQ ID NO: 754434 - RNA, 62 nt, hsa
cccugaugcccggaagcuccugcgugcauccccgggaugaccagacucccggacuccucagg

SEQ ID NO: 754435 - RNA, 62 nt, hsa
gugcgggcuugcaggaggaggcccagcagcugcgggaugagauugaggagcucaaugccgcc

SEQ ID NO: 754436 - RNA, 62 nt, hsa
gccuguaaucccagaacuuugggaggccaagacgggaugauugcuugagcucaggaguuuga

SEQ ID NO: 754437 - RNA, 62 nt, hsa
agagacauccauucgagaacugaagcggccuccgggaugaggucagaggccccaccugauuu

SEQ ID NO: 754438 - RNA, 62 nt, hsa
cugcuggagcagcaccaagagccagucuugaccgggaugaggcccacagacagguugucauc

SEQ ID NO: 754439 - RNA, 62 nt, hsa
uuucagacaaugaaaccuuugagugcccguagcgggaugaucucgguuggugagugcaggga

SEQ ID NO: 754440 - RNA, 62 nt, hsa
aagaguguggcaaagaacacccgugcuggggucgggaugagguugaagggucuuggucaaug

SEQ ID NO: 754441 - RNA, 62 nt, hsa
ggaaacaaguaucugaguucccuggagaucaacgggaugagguguuacagcugccucccucu

SEQ ID NO: 754442 - RNA, 62 nt, hsa
cugcugcuucuggaaguagucccccuuccucccgggaugaccucaggacucugucgguuucc

SEQ ID NO: 754443 - RNA, 62 nt, hsa
ccaugcgccgggcccagagcucccucugccugcgggaugagaccuuggcaggcgggcagcgg

SEQ ID NO: 754444 - RNA, 62 nt, hsa
caccacggcguuguaccuguaggacucucauucgggaugauuggaauagcuucuggaauuug

SEQ ID NO: 754445 - RNA, 62 nt, hsa
ccuucuacaaccacgagcagaugggccuucuccgggaugaggcccuggcagaggugaaggac

SEQ ID NO: 754446 - RNA, 62 nt, hsa
ugccccagcauuuccaacuggagcuggcucagcgggaugaggaugaaaaugucaacaucuau

SEQ ID NO: 754447 - RNA, 62 nt, hsa
cugugccggagucccugggggaggugcuggcgcgggaugaggacgggccacccuggcaccgg

SEQ ID NO: 754448 - RNA, 62 nt, hsa
gucucauuuacugauucguuuauggguaguaccgggaugaacccaccaccacaaagcaaauu

SEQ ID NO: 754449 - RNA, 62 nt, hsa
gccuguaaucccagcacugugagaggcugaggcgggaugaucaccugaggucaggaguucaa

SEQ ID NO: 754450 - RNA, 62 nt, hsa
aucagugggacuccaacaagcacaaugguucacgggaugaccagcucgucuucggucgugug

SEQ ID NO: 754451 - RNA, 62 nt, hsa
ugcuuuuuuuuguuaauuuuguucauauuuaucgggaugacaaauccauagaauauauucuu

SEQ ID NO: 754452 - RNA, 62 nt, hsa
agcccucccacggcccaucgucccgggugggccgggaugaugccccagugcggccggugcuc

SEQ ID NO: 754453 - RNA, 62 nt, hsa
accaagucacuuccccugcucgugcagaggcacgggaugagucugggugaccucugcgccau

SEQ ID NO: 754454 - RNA, 62 nt, hsa
gccacagcccagagaaccagccuaggaacacucgggaugacaccccuuaucacaccaaggac

SEQ ID NO: 754455 - RNA, 62 nt, hsa
ggcucugggcugcccugucggcuccuugagggcgggaugaacugcuuugugacuuggaaagg

SEQ ID NO: 754456 - RNA, 62 nt, hsa
gggcaaagcccccagagccucacuggccccggcgggaugaggagaccaugccgggcgcgcac

SEQ ID NO: 754457 - RNA, 62 nt, hsa
auggcgguucugcccaguggugucucugagcgcgggaugacaggagcaaccgaagcacccug

SEQ ID NO: 754458 - RNA, 62 nt, hsa
uccaguggacucuggggcgcggccacaggggacgggaugaggagcgggaggguuccgccacu

SEQ ID NO: 754459 - RNA, 62 nt, hsa
uaccccauuuguggucacagccaugaagucaccgggaugaaccuauccuuccaguggcucgc

SEQ ID NO: 754460 - RNA, 62 nt, hsa
cucagagaaacagcaagggcggggucaagacacgggaugacgggaagcaggaagcggggcag

SEQ ID NO: 754461 - RNA, 62 nt, hsa
gugcuuuuuagcagagacaccucguuaagcuccgggaugaccuuguaggagaucugucuccc

SEQ ID NO: 754462 - RNA, 62 nt, hsa
cuuucgcccgccugguggagcuguucuguagccgggaugacagcucucgcccaagccgagca

SEQ ID NO: 754463 - RNA, 62 nt, hsa
cccguccaccuggccgaggcagcccagagcagcgggaugagcuggcggccagagaacgccca

SEQ ID NO: 754464 - RNA, 62 nt, hsa
uaaguuacuaggauaguccacacucaagagaacgggaugauacaagagugugaauaaguccu

SEQ ID NO: 754465 - RNA, 62 nt, hsa
auccaaugggcauugugugggugcuuggaacccgggaugacugagggggacacuggaguggg

SEQ ID NO: 754466 - RNA, 62 nt, hsa
acacccagcuggccauauccaccccucgacgccgggaugagccggcucugccugugucacag

SEQ ID NO: 754467 - RNA, 62 nt, hsa
auucagugcuuccauugggggacaguccccuccgggaugaccugauucaccuccagcccagg

SEQ ID NO: 754468 - RNA, 62 nt, hsa
aaucaaauucugucuggggacgaaggguuggacgggaugaccuccagaagucccuucaauuu

SEQ ID NO: 754469 - RNA, 64 nt, hsa
ucucugcagaggcaaagucuacuuucugguaccucaaagaaaucauuguucaaucuuccauaag

SEQ ID NO: 754470 - RNA, 64 nt, hsa
uaacaugguauucuuuaagaagaaaaaacaaagccaaagaaaacucauuaucuggcauguucgc

SEQ ID NO: 754471 - RNA, 64 nt, hsa
gauuguaugaaguuuuaaaaaaaacuacagcagccaaagaaacuauauauauauauauauauau

SEQ ID NO: 754472 - RNA, 64 nt, hsa
ugggaauaucauagaguaacaagugcuggucagccaaagaaacauucacugcuggugaaccaau

SEQ ID NO: 754473 - RNA, 64 nt, hsa
ugaauucauucauauuugccaguauugcucacuucaaagaaacuccuucaucaagcaguccaga

SEQ ID NO: 754474 - RNA, 64 nt, hsa
cacaaucagaaucacagaaaaauccugccuaaggcaaagaaauauaagacaagacuaugauauc

SEQ ID NO: 754475 - RNA, 64 nt, hsa
gugaccuguacaagugaugcagaaaggaggguuucaaagaaaaaggauuuuguuuaaaauacuu

SEQ ID NO: 754476 - RNA, 64 nt, hsa
gcagcagaaugagccaggaguagcaggagaugggcaaagaaaacuggggugcacucagcucuca

SEQ ID NO: 754477 - RNA, 64 nt, hsa
uuucaaguuuuaaaguucauugcaauuaaacuuccaaagaaaguucuacaguguccuaagugcu

SEQ ID NO: 754478 - RNA, 64 nt, hsa
uuugcuugccaaaguacagaauuugaauuaucagcaaagaaaaaaaaaaaagccagccaagcuu

SEQ ID NO: 754479 - RNA, 64 nt, hsa
ugcauuucauauagcuuuuucauuuaaaacaagacaaagaaacaaauuccuaugaccaaauugc

SEQ ID NO: 754480 - RNA, 64 nt, hsa
gaaagucuggccaacagagcaguagaugauauaacaaagaaagcaugcuuucugaggagauagu

SEQ ID NO: 754481 - RNA, 64 nt, hsa
uucaaauauaaguuuccaugcuuuuuuguaacaucaaagaaaacauacccaucaguaauuucuc

SEQ ID NO: 754482 - RNA, 64 nt, hsa
aagcacagauacuuugugaguuccuacccucuuccaaagaaagaccacgugugcauguugucau

SEQ ID NO: 754483 - RNA, 64 nt, hsa
cuugaaaauguuuauuuaaaaaaaaaaaagaugacaaagaaaaacagagagagagaauauugga

SEQ ID NO: 754484 - RNA, 64 nt, hsa
aacaggaacccaccaaaccaaccaaucaaccaaacaaagaaaaaauuccacaaugaaagaaugu

SEQ ID NO: 754485 - RNA, 64 nt, hsa
uacuuugaacauuaauguugaaaaagaaaacaaccaaagaaaauugguacuuacccuucuacaa

SEQ ID NO: 754486 - RNA, 64 nt, hsa
gaaauauuugcucaauaugaucuugauauuccuacaaagaaaaaagaagggguagggauuuggc

SEQ ID NO: 754487 - RNA, 64 nt, hsa
gaaacuuaagaugugcaaggagauuuaaugauuucaaagaaaauaaugguucuuuguuuuuaau

SEQ ID NO: 754488 - RNA, 64 nt, hsa
auuuggaaaaaugaaauuuaguaguuccaaguuucaaagaaaugucaacauuuuauuccauuca

SEQ ID NO: 754489 - RNA, 64 nt, hsa
uguaaaauguucuaagauaaaaaaacucgagcuacaaagaaagaaugaacuaauucuuuacaaa

SEQ ID NO: 754490 - RNA, 64 nt, hsa
uccauguaguccaaauuugucauuaaaaaaaaaucaaagaaagaaggccacguauguuggggua

SEQ ID NO: 754491 - RNA, 64 nt, hsa
cauaaauguaauaacugaggaggccuuuguucagcaaagaaaccuuauacaaacucguauaaag

SEQ ID NO: 754492 - RNA, 64 nt, hsa
agaaggcugugccuagaacaaagaaucaggcuggcaaagaaaucacaggucuuuccucaaacuu

SEQ ID NO: 754493 - RNA, 64 nt, hsa
gguacucuuggauguguuuucucaccaagaugagcaaagaaagguuugcacagaggagugugaa

SEQ ID NO: 754494 - RNA, 64 nt, hsa
ccuugaagaauggguucugugucuaauccugaaacaaagaaaacuacaagcuggaguguaggaa

SEQ ID NO: 754495 - RNA, 64 nt, hsa
auuguccuuaauugaugcaaauaacacaaaugcucaaagaaaucuacuauaucccuuaaugaaa

SEQ ID NO: 754496 - RNA, 64 nt, hsa
gaaagcgcaaugucagaagcgauuaugaaagcaacaaagaaauccggagaagcugccaggugag

SEQ ID NO: 754497 - RNA, 64 nt, hsa
ucucucaguccuuuugcuacauucacuuucuuuucaaagaaauguuaauuauuacaaaaauuga

SEQ ID NO: 754498 - RNA, 64 nt, hsa
augaaguaaaccaauagauacucuuuugauucuccaaagaaauauaauuuugguuuuuguuccu

SEQ ID NO: 754499 - RNA, 64 nt, hsa
acuccagccugggugacagagcgagacuguguuucaaagaaaaaaaaaaacaagcagccuuuug

SEQ ID NO: 754500 - RNA, 64 nt, hsa
guccauguacucagauaaacaugaagaaaauaagcaaagaaaaauggagacugggaaagcaaag

SEQ ID NO: 754501 - RNA, 64 nt, hsa
agaaaguaacuaucuugaagguuugaaaaacaaccaaagaaagggagugaggacuauggcugca

SEQ ID NO: 754502 - RNA, 64 nt, hsa
gaagacaaagaagguaggaacggaauuuugagggcaaagaaaccuguguuuccauggaauugcu

SEQ ID NO: 754503 - RNA, 64 nt, hsa
acuuguggggacuuaggcaugacacagguucuugcaaagaaacuagaggcuggcuucacuagag

SEQ ID NO: 754504 - RNA, 64 nt, hsa
aaagugauugcugggagcaaaaacuagaaugauacaaagaaaggucagagaaaugcaugggaau

SEQ ID NO: 754505 - RNA, 64 nt, hsa
uugauggaagguauuaaacuauuugccuguuguacaaagaaauguuaagacucgugaaaagaau

SEQ ID NO: 754506 - RNA, 64 nt, hsa
uugcugcaaagagcugcugcuuugccaaccuaagcaaagaaaauacggcuucucuugcauuauu

SEQ ID NO: 754507 - RNA, 64 nt, hsa
aguaaacagaguaauguuuuuuuucuuauuuucccaaagaaagaaaagggggaaaauauauuug

SEQ ID NO: 754508 - RNA, 64 nt, hsa
acagguuuaaacuggacuuagcuugaguuaaaggcaaagaaaaucuaaaaacauaaauguuaua

SEQ ID NO: 754509 - RNA, 64 nt, hsa
ggagugggucuaucucagaggaaggaacaggaaacaaagaaaggaagccacugaacaucccuuc

SEQ ID NO: 754510 - RNA, 64 nt, hsa
aguccagaacugaauccuaagaaaugcaggacugcaaagaaauuggugugugugugugugugug

SEQ ID NO: 754511 - RNA, 64 nt, hsa
agaaauauuaauaccacauggggagaaccccaaccaaagaaaucugaaauauauaguaaaugcu

SEQ ID NO: 754512 - RNA, 64 nt, hsa
aaagcaaaaagcaggccacaaccuuaaccaacaccaaagaaacauccaagcaauaaaguggaag

SEQ ID NO: 754513 - RNA, 64 nt, hsa
agauuauccaugggugaugagggacuggcugaaccaaagaaacaauuuucuucuuccuuauuuc

SEQ ID NO: 754514 - RNA, 64 nt, hsa
auuguaaaaauuuuuaaaacacagaaacuauaugcaaagaaaaaauaaaaauuaucuauaaucu

SEQ ID NO: 754515 - RNA, 64 nt, hsa
gaggaugaagauaaggaagauacguuaccauugucaaagaaagcaaaauuugauucauaauaau

SEQ ID NO: 754516 - RNA, 64 nt, hsa
aauuggcaauuuaacgagccacuuccaugaucuccaaagaaaccaaaauacaaacacaauauuu

SEQ ID NO: 754517 - RNA, 64 nt, hsa
gagacucgcuuguauuuuaagagaaccaaguggccaaagaaacucuuucuaacuuuggcaacau

SEQ ID NO: 754518 - RNA, 64 nt, hsa
uugcacaaaugucaaaaaaaagaugguaauaucucaaagaaaugaacuuguagauuaccaagca

SEQ ID NO: 754519 - RNA, 64 nt, hsa
ccugggcauccuaaugcuuacucugguuguuacacaaagaaaauauuggggucacuggcgagcc

SEQ ID NO: 754520 - RNA, 64 nt, hsa
ggauuuuaauuguuucaucacaccuuccccguggcaaagaaacagucaguccucuucagguguc

SEQ ID NO: 754521 - RNA, 64 nt, hsa
uguagcauuuguaagauuuguaaaugaugaaauucaaagaaaacuuuuucuauugcuaggagcc

SEQ ID NO: 754522 - RNA, 64 nt, hsa
aguauacuucaguauacuagugcaacaagggacacaaagaaauucugucuuaauaaagaaagcu

SEQ ID NO: 754523 - RNA, 64 nt, hsa
uuaagguagcccucucaucgucuuuuaguuccaacaaagaaaggugccaugucuuuacuagacu

SEQ ID NO: 754524 - RNA, 64 nt, hsa
aguuguaaaaugucaagaaauucugcuguuacgacaaagaaacauuuuacgcuagauuaaaaua

SEQ ID NO: 754525 - RNA, 64 nt, hsa
gaaccugauuugcacucuguaguguuuaaagaaacaaagaaacucuaauauugaaucucuuaaa

SEQ ID NO: 754526 - RNA, 64 nt, hsa
cguauugucuaaaugcauuuaaaucuguuuuauucaaagaaaagcuaaagcaaaaacacuggca

SEQ ID NO: 754527 - RNA, 64 nt, hsa
cggccacaagggacugaggcaagcacaaugguuucaaagaaagacuguaagcuccaugauuagc

SEQ ID NO: 754528 - RNA, 64 nt, hsa
ggcuugggaaacugagguguuauuuucaaugaaacaaagaaagagauguuaagcaagugguugu

SEQ ID NO: 754529 - RNA, 64 nt, hsa
aacuguauaaagggauugguagucaaaacauguacaaagaaauaccuguaaaacuguuuugucu

SEQ ID NO: 754530 - RNA, 64 nt, hsa
acuguguuggacauauuauuuagacuuagucauacaaagaaacuuagcucuuuuuucaucucac

SEQ ID NO: 754531 - RNA, 64 nt, hsa
gaauuucugaugauuuggguucuuuuccauaguccaaagaaacagaucagcucuucagguauca

SEQ ID NO: 754532 - RNA, 64 nt, hsa
guuacaugguaacagugaauggcuuaguaccuggcaaagaaaguaaaauuguuuuuucuguccg

SEQ ID NO: 754533 - RNA, 64 nt, hsa
ucaagccuuacuacccaucuuuuauuccauacugcaaagaaauuuugcaaauguaaagaauaug

SEQ ID NO: 754534 - RNA, 64 nt, hsa
aagauuucuacaaugagaauuacaaagcagugcacaaagaaaucagaaacaauaaaaauugaaa

SEQ ID NO: 754535 - RNA, 64 nt, hsa
aguuaaaaaaacagccagauuaucauuugcuuaacaaagaaaucaugcaauuaccauaaauggu

SEQ ID NO: 754536 - RNA, 64 nt, hsa
gguaagccuuuauccuaagucugaaaauucauaucaaagaaaauuuuauggauguaaauuguuc

SEQ ID NO: 754537 - RNA, 64 nt, hsa
uaaaaaauuguaaggcaauuuuuaguauuguugucaaagaaaagcuuggauuacauuaacauuu

SEQ ID NO: 754538 - RNA, 64 nt, hsa
guauaggcaguauacacagcacuacucaagaagccaaagaaacacuugugcagugcuaaguguc

SEQ ID NO: 754539 - RNA, 64 nt, hsa
agaggggguggggagguaaauuccucugacuugccaaagaaaaagaagggaaccacaguggaua

SEQ ID NO: 754540 - RNA, 64 nt, hsa
ggcauuccugaauaauuuccaaauguuuuuaauccaaagaaaaagguuuaaagcuuauuucccu

SEQ ID NO: 754541 - RNA, 64 nt, hsa; identical to SEQ ID NO: 45780

SEQ ID NO: 754542 - RNA, 64 nt, hsa; identical to SEQ ID NO: 45781

SEQ ID NO: 754543 - RNA, 64 nt, hsa; identical to SEQ ID NO: 45782

SEQ ID NO: 754544 - RNA, 64 nt, hsa; identical to SEQ ID NO: 45783

SEQ ID NO: 754545 - RNA, 64 nt, hsa; identical to SEQ ID NO: 45784

SEQ ID NO: 754546 - RNA, 64 nt, hsa; identical to SEQ ID NO: 45785

SEQ ID NO: 754547 - RNA, 64 nt, hsa; identical to SEQ ID NO: 45786

SEQ ID NO: 754548 - RNA, 64 nt, hsa; identical to SEQ ID NO: 45787

SEQ ID NO: 754549 - RNA, 64 nt, hsa; identical to SEQ ID NO: 45788

SEQ ID NO: 754550 - RNA, 64 nt, hsa; identical to SEQ ID NO: 45789

SEQ ID NO: 754551 - RNA, 64 nt, hsa; identical to SEQ ID NO: 45790

SEQ ID NO: 754552 - RNA, 64 nt, hsa; identical to SEQ ID NO: 45791

SEQ ID NO: 754553 - RNA, 64 nt, hsa; identical to SEQ ID NO: 45792

SEQ ID NO: 754554 - RNA, 64 nt, hsa; identical to SEQ ID NO: 45793

SEQ ID NO: 754555 - RNA, 64 nt, hsa; identical to SEQ ID NO: 45794

SEQ ID NO: 754556 - RNA, 64 nt, hsa; identical to SEQ ID NO: 45795

SEQ ID NO: 754557 - RNA, 64 nt, hsa; identical to SEQ ID NO: 45796

SEQ ID NO: 754558 - RNA, 64 nt, hsa; identical to SEQ ID NO: 45797

SEQ ID NO: 754559 - RNA, 64 nt, hsa; identical to SEQ ID NO: 45798

SEQ ID NO: 754560 - RNA, 64 nt, hsa; identical to SEQ ID NO: 45799

SEQ ID NO: 754561 - RNA, 64 nt, hsa; identical to SEQ ID NO: 45800

SEQ ID NO: 754562 - RNA, 64 nt, hsa; identical to SEQ ID NO: 45801

SEQ ID NO: 754563 - RNA, 64 nt, hsa; identical to SEQ ID NO: 45802

SEQ ID NO: 754564 - RNA, 64 nt, hsa; identical to SEQ ID NO: 45803

SEQ ID NO: 754565 - RNA, 64 nt, hsa; identical to SEQ ID NO: 45804

SEQ ID NO: 754566 - RNA, 64 nt, hsa; identical to SEQ ID NO: 45805

SEQ ID NO: 754567 - RNA, 64 nt, hsa; identical to SEQ ID NO: 45806

SEQ ID NO: 754568 - RNA, 64 nt, hsa
gugaagcaugaagggaaucauaggaaaaauguacugaucauauaauuaacauuauguacuguau

SEQ ID NO: 754569 - RNA, 64 nt, hsa
ucauuucaccuucccuguacuguauguuuggaauugaucauaaaacaucuccaaaagaaaauaa

SEQ ID NO: 754570 - RNA, 64 nt, hsa
cugacucuguugcccaagcuggagugcaguggcaugaucauagcucauuguaaccucaaacucc

SEQ ID NO: 754571 - RNA, 64 nt, hsa
uucuuuuaagcucuaugcaaucaugcaaacauagugaucauagcgucaacauggucuggagugu

SEQ ID NO: 754572 - RNA, 64 nt, hsa
cauaaguugaaaauaugaucauaaguugaaaauaugaucauaagucaaaaauguauuuaauaua

SEQ ID NO: 754573 - RNA, 64 nt, hsa
ugcauccugauaaacccaucauaaguugaaaauaugaucauaaguugaaaauaugaucauaagu

SEQ ID NO: 754574 - RNA, 64 nt, hsa
gugcacauucaaaguuaagcuauuaaauauagggugaucauaguuccucuaccaagucuggaaa

SEQ ID NO: 754575 - RNA, 64 nt, hsa
ucuuggccuugcuccacaggacauaggcaagccuugaucauaguucauacauauaaaugguggu

SEQ ID NO: 754576 - RNA, 62 nt, hsa
cauguauuauuauuauuuuugagauggaguuuugcucuuaaugauauuauuauuauuugaga

SEQ ID NO: 754577 - RNA, 62 nt, hsa
uaaugauauuauuauuauuugagacagaguuuugcucuuauugcccaggcuggagugcagug

SEQ ID NO: 754578 - RNA, 62 nt, hsa
auugucugucugcucuuauuuuuguaccauauugcucuuaaaaaucuugguuugguacaguu

SEQ ID NO: 754579 - RNA, 62 nt, hsa
uugaaugccugucccaguccaaauugucugucugcucuuauuuuuguaccauauugcucuua

SEQ ID NO: 754580 - RNA, 62 nt, hsa
cuuugccucucaauugucauugauacaugcauugcucuuauucugucuggcauuacaauugc

SEQ ID NO: 754581 - RNA, 62 nt, hsa
augaaaaccugaagaguucacuuuuguuauuaugcucuuaaugauuuacagacugaugccag

SEQ ID NO: 754582 - RNA, 62 nt, hsa
aguggauggauagucugcuuguuuuuaguuuuugcucuuaacaaacacugcugcagucagca

SEQ ID NO: 754583 - RNA, 62 nt, hsa
uaacaaauacucagcaaaugugaaacuuuauuugcucuuacuucaaaauuaguccaaaaugu

SEQ ID NO: 754584 - RNA, 62 nt, hsa
cuguugaacaccccucuuagggauguuucuuuugcucuuauuuccugcaucuuuccuuaagg

SEQ ID NO: 754585 - RNA, 62 nt, hsa
gguuucuaugauugaccuugagguuuacuccuugcucuuacaacauuucuaaggauuuuuaa

SEQ ID NO: 754586 - RNA, 62 nt, hsa
aaucggcuuaaaauucccuuucuuaaauguugugcucuuauguucucggcuuuuuaaugacu

SEQ ID NO: 754587 - RNA, 62 nt, hsa
agaaacugugcauuccagaucuacauacuaaaugcucuuaucauuuugaaaugggcucuuga

SEQ ID NO: 754588 - RNA, 62 nt, hsa
uuuuuguuauuaaauggaaaaggccugaauuaugcucuuaugugaaguaaauugauauaacc

SEQ ID NO: 754589 - RNA, 62 nt, hsa
auuggguuugaaagauuuugaauuauagacagugcucuuaauaguuuuuaauaaguugauau

SEQ ID NO: 754590 - RNA, 62 nt, hsa
acaggugugagccaccaugccuggccgugguuugcucuuaauguuuuuaaggaugguuguga

SEQ ID NO: 754591 - RNA, 62 nt, hsa
aagaaaucuuaaguagaauucucuaaaagguuugcucuuaauguuuucuuuguuuuguuuug

SEQ ID NO: 754592 - RNA, 62 nt, hsa
ugggugaggggacccuacucuguuaucccaagugcucuuauucuggugagaagaaccuuacu

SEQ ID NO: 754593 - RNA, 62 nt, hsa
cuccuacuaccaccacacaaacuuaguucauaugcucuuacuugggcaagggugcuuuccuu

SEQ ID NO: 754594 - RNA, 64 nt, hsa
cccucuuccuuugaaggccccagcaccucugcccuguggucaccgaaucuguacuaaggaccug

SEQ ID NO: 754595 - RNA, 64 nt, hsa
acaaguuggcuagaagauacauggagaggaaugguguggucaacaguuaaugaaacgguucuau

SEQ ID NO: 754596 - RNA, 64 nt, hsa
uucagucauaggcgaaucuguucugcccgaggcuuguggucaagcaaaaauucagcccugaaau

SEQ ID NO: 754597 - RNA, 64 nt, hsa
aucaacaauccaaugcucaccuauucaguugcucuguggucaguguggcugcauaacaguggau

SEQ ID NO: 754598 - RNA, 64 nt, hsa
aggccagagaccccaggcagccugagcucuuggauguggucagcucuccaggagcaaguccugu

SEQ ID NO: 754599 - RNA, 64 nt, hsa
acggugcagucggcugcauacucccagucgggaguguggucagucugccugcugcugugcggua

SEQ ID NO: 754600 - RNA, 64 nt, hsa
caugcaaaggaagggauggggugagcgcaaggccuguggucagcagcuacugaugguuuuuucu

SEQ ID NO: 754601 - RNA, 64 nt, hsa
auuuauuugccuguuuuuguuuuuuuacuugagcuguggucacagcugccagguaccuaagcaa

SEQ ID NO: 754602 - RNA, 64 nt, hsa
ggcuuucuaagaaaaacuuuauuuugcauaagcauguggucagaucauuuugugcauaugcagc

SEQ ID NO: 754603 - RNA, 64 nt, hsa
aaucuguuuuuauuuuugucauguagaauacuacuguggucaucauaauguaaucuauuucugu

SEQ ID NO: 754604 - RNA, 64 nt, hsa
acaaagauacuccaaaauacaauggcuuaaagaauguggucauuuauucuuuauuauuuauuua

SEQ ID NO: 754605 - RNA, 64 nt, hsa
aauguggucauuuauucuuuauuauuuauuuauuuguggucaaauaaauaaauaagguuauuua

SEQ ID NO: 754606 - RNA, 64 nt, hsa
ugccuucaguuuguguuguguauauuuugauguauguggucacuaacaggucacuuuuauuuuu

SEQ ID NO: 754607 - RNA, 64 nt, hsa
uuaauguugucuuaaaauuucuugauugugauacuguggucauaugcccguguuugucacuuac

SEQ ID NO: 754608 - RNA, 64 nt, hsa
uugacuucuuccgucgagugcgugcauccuacuauguggucagugggaaugacccugccaaugg

SEQ ID NO: 754609 - RNA, 64 nt, hsa
gaucccuucucauccccugcuuggcuucucugcauguggucaucugcuguggcuugguguuuaa

SEQ ID NO: 754610 - RNA, 64 nt, hsa
aacacuaccugaugcuuuccuuguucguggggauuguggucacaugaagcucuuucugcaucag

SEQ ID NO: 754611 - RNA, 64 nt, hsa
agcgccacaguugcccuccccggacgugguguuauguggucauuucagcccuaacuucugugug

SEQ ID NO: 754612 - RNA, 64 nt, hsa
ugcucaauuccuucuucaacgccaucuccacucuuguggucaucauggccagcacgccgcucuu

SEQ ID NO: 754613 - RNA, 64 nt, hsa
uuguggucaucauggccagcacgccgcucuucacuguggucauccugccccuggcugugcucua

SEQ ID NO: 754614 - RNA, 64 nt, hsa
ccagucuuucuuuaacaucaaucaaccguagcaauguggucaucacgaagucuucauugacuca

SEQ ID NO: 754615 - RNA, 64 nt, hsa
cacuauuaagcagcuugguuuugacauguuauguuguggucaucuuuucaugucaauacauaga

SEQ ID NO: 754616 - RNA, 64 nt, hsa
ccaaggcccaggagggacuugggcaguauguucauguggucauauguuuuuguaaaaaauugug

SEQ ID NO: 754617 - RNA, 64 nt, hsa
gaauuauucauuugcccaaaaggacuuaagugguuguggucauccaucauuguauuuaucaaga

SEQ ID NO: 754618 - RNA, 64 nt, hsa
uccgagcuccuguggaaguugcuccuugcgcugauguggucacucggcuagcaggcccuucugu

SEQ ID NO: 754619 - RNA, 64 nt, hsa
gcgcugauguggucacucggcuagcaggcccuucuguggucaaccacaugaugccugcuaguua

SEQ ID NO: 754620 - RNA, 64 nt, hsa
aggagcagaaggaagacuacuugccuguucucaguguggucaguguuaccauccauacuguguc

SEQ ID NO: 754621 - RNA, 64 nt, hsa
gggagaccucuuagaucaguucuuuuguacuacuuguggucagcacuaucauggaaugugccug

SEQ ID NO: 754622 - RNA, 64 nt, hsa
ugggaucaauuucauuaccguguaccuuucccauuguggucaugccauuuggcagggggagaau

SEQ ID NO: 754623 - RNA, 64 nt, hsa
cucugugaggcaucuggccauucgcacucccugguguggucagccucucucacacaaggaggaa

SEQ ID NO: 754624 - RNA, 64 nt, hsa
aauagcaggagcauguugauuucuugguuagguugcauuauaauaacaagagucagaacauuaa

SEQ ID NO: 754625 - RNA, 64 nt, hsa
agaucauuucuggaggcuucagcaauggaauuuagcauuauaagagagauuggacaaaccaguc

SEQ ID NO: 754626 - RNA, 64 nt, hsa
ucucucuuuauccuaugugauuccugcucugaaugcauuauauuuuccaaacuauacccauaaa

SEQ ID NO: 754627 - RNA, 64 nt, hsa
caucaauugcagacugugaaguuguguauuuaaugcauuauagcaugguggaaaauaagguuca

SEQ ID NO: 754628 - RNA, 64 nt, hsa
uuacucaacauuagagaguuaguacguaauaaaagcauuauaaaugcaauuuuugucaagagau

SEQ ID NO: 754629 - RNA, 64 nt, hsa
uccaugaaguagguuuucagagcaauauucuucugcauuauaguaagagaaaaccauuuuuaau

SEQ ID NO: 754630 - RNA, 64 nt, hsa
cauucagucaggcacugggaucaucuguuuacaggcauuauauuuauuuggcacuccuggaaca

SEQ ID NO: 754631 - RNA, 64 nt, hsa
uacaaagaaggcaaauucuuuaaucaaauaaagcgcauuauaaaaugagauguuuauuggauua

SEQ ID NO: 754632 - RNA, 64 nt, hsa
guuuguguuuuucuauagcagagcauuauauuuugcauuauauguuucaaccuagucuaagugg

SEQ ID NO: 754633 - RNA, 64 nt, hsa
agccauuuacauguuuguguuuuucuauagcagagcauuauauuuugcauuauauguuucaacc

SEQ ID NO: 754634 - RNA, 64 nt, hsa
gugaauauguggaaauaauuucccagcaggaagagcauuauauucucuuuguaccagcaaauua

SEQ ID NO: 754635 - RNA, 64 nt, hsa
ugcuuccacagucaaagcuggacauuuuuauguugcauuauauacacccaugauauuucuaaua

SEQ ID NO: 754636 - RNA, 64 nt, hsa; identical to SEQ ID NO: 558528

SEQ ID NO: 754637 - RNA, 64 nt, hsa; identical to SEQ ID NO: 558529

SEQ ID NO: 754638 - RNA, 64 nt, hsa; identical to SEQ ID NO: 558530

SEQ ID NO: 754639 - RNA, 64 nt, hsa; identical to SEQ ID NO: 558531

SEQ ID NO: 754640 - RNA, 64 nt, hsa; identical to SEQ ID NO: 558532

SEQ ID NO: 754641 - RNA, 64 nt, hsa; identical to SEQ ID NO: 558533

SEQ ID NO: 754642 - RNA, 64 nt, hsa; identical to SEQ ID NO: 558534

SEQ ID NO: 754643 - RNA, 64 nt, hsa; identical to SEQ ID NO: 558535

SEQ ID NO: 754644 - RNA, 64 nt, hsa; identical to SEQ ID NO: 558536

SEQ ID NO: 754645 - RNA, 64 nt, hsa; identical to SEQ ID NO: 558537

SEQ ID NO: 754646 - RNA, 64 nt, hsa; identical to SEQ ID NO: 558538

SEQ ID NO: 754647 - RNA, 64 nt, hsa; identical to SEQ ID NO: 558539

SEQ ID NO: 754648 - RNA, 64 nt, hsa; identical to SEQ ID NO: 558540

SEQ ID NO: 754649 - RNA, 64 nt, hsa; identical to SEQ ID NO: 558541

SEQ ID NO: 754650 - RNA, 54 nt, hsa; identical to SEQ ID NO: 558542

SEQ ID NO: 754651 - RNA, 64 nt, hsa; identical to SEQ ID NO: 558543

SEQ ID NO: 754652 - RNA, 64 nt, hsa; identical to SEQ ID NO: 558544

SEQ ID NO: 754653 - RNA, 64 nt, hsa; identical to SEQ ID NO: 558545

SEQ ID NO: 754654 - RNA, 64 nt, hsa; identical to SEQ ID NO: 558546

SEQ ID NO: 754655 - RNA, 64 nt, hsa; identical to SEQ ID NO: 558547

SEQ ID NO: 754656 - RNA, 64 nt, hsa; identical to SEQ ID NO: 558548

SEQ ID NO: 754657 - RNA, 64 nt, hsa; identical to SEQ ID NO: 558549

SEQ ID NO: 754658 - RNA, 64 nt, hsa; identical to SEQ ID NO: 558550

SEQ ID NO: 754659 - RNA, 64 nt, hsa; identical to SEQ ID NO: 558551

SEQ ID NO: 754660 - RNA, 64 nt, hsa; identical to SEQ ID NO: 558552

SEQ ID NO: 754661 - RNA, 64 nt, hsa; identical to SEQ ID NO: 558553

SEQ ID NO: 754662 - RNA, 64 nt, hsa; identical to SEQ ID NO: 558554

SEQ ID NO: 754663 - RNA, 64 nt, hsa; identical to SEQ ID NO: 628786

SEQ ID NO: 754664 - RNA, 64 nt, hsa; identical to SEQ ID NO: 628787

SEQ ID NO: 754665 - RNA, 64 nt, hsa; identical to SEQ ID NO: 628788

SEQ ID NO: 754666 - RNA, 64 nt, hsa; identical to SEQ ID NO: 628789

SEQ ID NO: 754667 - RNA, 64 nt, hsa; identical to SEQ ID NO: 628790

SEQ ID NO: 754668 - RNA, 64 nt, hsa; identical to SEQ ID NO: 628791

SEQ ID NO: 754669 - RNA, 64 nt, hsa; identical to SEQ ID NO: 628792

SEQ ID NO: 754670 - RNA, 64 nt, hsa; identical to SEQ ID NO: 628793

SEQ ID NO: 754671 - RNA, 64 nt, hsa
aauaguacacacuucagaguaagacaaaugcaaagcaucuuaaggagugaaaauagaguguaaa

SEQ ID NO: 754672 - RNA, 64 nt, hsa
cuccucugcuuuaugaaguuugaguuguauuugugcaucuuaaaguagguugaggcuugaggcu

SEQ ID NO: 754673 - RNA, 64 nt, hsa
uaagguagcauucauuaccuguuuauucucugcugcaucuuacagaagaguaaacuggugagag

SEQ ID NO: 754674 - RNA, 64 nt, hsa
aaucucugcuaaguggaccuggaaucuuccaucugcaucuuaacaugcucucuagguguuucuu

SEQ ID NO: 754675 - RNA, 62 nt, hsa
cgccugguuuuuccauauggcucaugaucuaauuuaaggaacaaguaacuaaaaauguuaag

SEQ ID NO: 754676 - RNA, 62 nt, hsa
cucaaaaucaggugaagcuaggaagauggagcuuuaaggagcauggcuagugcucugaguag

SEQ ID NO: 754677 - RNA, 62 nt, hsa
ugcauuuucacccauucugugguucauuguaguuuaaggaaaccaagcauauagaugcauua

SEQ ID NO: 754678 - RNA, 62 nt, hsa
ucucuuaaaaauaccacaguuuguauuuuuucuuuaaggaguaaagauuugccuuuaaauaa

SEQ ID NO: 754679 - RNA, 62 nt, hsa
aaaaggaauauucuuauguaguuauucuaaaguuuaaggagcguuguugaccauaauauugc

SEQ ID NO: 754680 - RNA, 62 nt, hsa
aauuugagcaggucguugauggcaaaaauaauuuuaaggaaaaaggaauauucuuauguagu

SEQ ID NO: 754681 - RNA, 62 nt, hsa
gggguuaauauaaaucaaggaggaaguuuauauuuaaggaagaauuggagugacguaucuua

SEQ ID NO: 754682 - RNA, 62 nt, hsa
uuuuauaaugaugucuuagagggacugaaagguuuaaggaggcgaucaaacuaaaaugucuu

SEQ ID NO: 754683 - RNA, 62 nt, hsa
ccuaauagcugccucaugacaaguacauguuauuuaaggaggaaaaaauauuaaauuuugaa

SEQ ID NO: 754684 - RNA, 62 nt, hsa
auuugcuuauacucagugccugugauauugaguuuaaggauuugaggcagggguaauuauua

SEQ ID NO: 754685 - RNA, 62 nt, hsa
uagucagaaagaugagaggauuaguuauacaauuuaaggaagggaggauaacuuugggaagg

SEQ ID NO: 754686 - RNA, 62 nt, hsa
guacugauggauguuuugaaagugagcauucauuuaaggauaaauaaaaaauaaaguaguaa

SEQ ID NO: 754687 - RNA, 62 nt, hsa
cacguguugcaaguauaaaagcaucacugggauuuaaggagaauugagagaauguacccaca

SEQ ID NO: 754688 - RNA, 62 nt, hsa
gauauaaacagagaaauaccuuuagaggugacuuuaaggaaaaugaagaaaaagaaccaaaa

SEQ ID NO: 754689 - RNA, 62 nt, hsa
uuuuaaauucaaauaaggauggcagugcccauuuuaaggaggauuucagcuauaacugagga

SEQ ID NO: 754690 - RNA, 62 nt, hsa
ugaaccucaugggacuuuuaaaagaagggcuauuuaaggaauucacuugguaguacuuugcu

SEQ ID NO: 754691 - RNA, 62 nt, hsa
ugauacauugaacaaaauggaacucauuuuuuuuuaaggaguaaagauuuuuaauucuguga

SEQ ID NO: 754692 - RNA, 62 nt, hsa
acauuuugaaauaugcaaagaaagacuuuuuuuuuaaggaaaggaaaaccuuauaaugacga

SEQ ID NO: 754693 - RNA, 62 nt, hsa
aaaauuuggagucauaggauauugaugcacaauuuaaggauuaaacauuuuuaaucaauugu

SEQ ID NO: 754694 - RNA, 62 nt, hsa
uuucccuccauaaguuuaacuuuaaaacuguauuuaaggaaucaaaucuuacaaaauccugg

SEQ ID NO: 754695 - RNA, 62 nt, hsa
gcuugcuaagaauuugagcacauguagcuaauuuuaaggagggcucaagugagcaaggguuu

SEQ ID NO: 754696 - RNA, 62 nt, hsa
uuucucuuuugauucaauuauacugcacauguuuuaaggaaaaguaacuuaauuggguuuuu

SEQ ID NO: 754697 - RNA, 62 nt, hsa
uuuacauauuuuucauuuuauuucguauuuucuuuaaggagugcuuucucaaucauuaauag

SEQ ID NO: 754698 - RNA, 62 nt, hsa
uuuucaaaaguuggcagauuuuuuuuuuuguuuuuaaggaaaaaggcaugcuuucugacuga

SEQ ID NO: 754699 - RNA, 62 nt, hsa
aacauuuugggaaacacuauguuagauaguucuuuaaggagacaaaacgguaaugaacagau

SEQ ID NO: 754700 - RNA, 62 nt, hsa
guuuauuaaagauugacauuuuaaguacaacuuuuaaggacuaauuacugugauggacacag

SEQ ID NO: 754701 - RNA, 62 nt, hsa
cugcaguuuuuucuaugugggaugauuacuuuuuuaaggaggauuaauucugagguaguaua

SEQ ID NO: 754702 - RNA, 62 nt, hsa
auggauuuguguucuuacaguacuugaaaauauuuaaggaagagaugaagcucugcaguuuu

SEQ ID NO: 754703 - RNA, 62 nt, hsa
acagcuuccuuuuagaaggucugauaaggauauuuaaggaagaagagaaugacucuguuauu

SEQ ID NO: 754704 - RNA, 62 nt, hsa
cagaaucacacuccuguguaucccggcuacacuuuaaggaaagauugaaucuaagcugugaa

SEQ ID NO: 754705 - RNA, 62 nt, hsa
agcaauaaauaacacuugucagccucagagcauuuaaggaaacuagacaaguaaaauuaucc

SEQ ID NO: 754706 - RNA, 62 nt, hsa
uuacccuccaagucuguaccucaaaugaauucuuuaaggagauggacuaauugacuugcaaa

SEQ ID NO: 754707 - RNA, 62 nt, hsa
acauugauuuuuaaaacugcugcuuuuuaugcuuuaaggaaaauguauuucauauuugaguu

SEQ ID NO: 754708 - RNA, 62 nt, hsa
aacuauuuaguuuuuccacuuuaccuucaugauuuaaggaacauguauuagcuguguuuuag

SEQ ID NO: 754709 - RNA, 62 nt, hsa
aguuccauuucagauuucuucuuugccacccuuuuaaggacuuugaauuuuucuuugucuuu

SEQ ID NO: 754710 - RNA, 62 nt, hsa
uucugcucggcaauuuguaaguuuacauguuauuuaaggauaaagguaaaucauucaaggca

SEQ ID NO: 754711 - RNA, 62 nt, hsa
uuugauguaauaaaacuugguuggcuugauauuuuaaggaauugaaaccuagcaaucuuauu

SEQ ID NO: 754712 - RNA, 62 nt, hsa
aucaaauuucugugguuuuuauggccagaaauuuuaaggacuugugugugcugggauaugag

SEQ ID NO: 754713 - RNA, 62 nt, hsa
aagaguacuagacuggaccuucucauauuacguuuaaggaagacuuagaguguucauugaug

SEQ ID NO: 754714 - RNA, 62 nt, hsa
uccuaaagugauuagcacuaaucucugggauuuuuaaggauugcacuacagaagaauguacc

SEQ ID NO: 754715 - RNA, 62 nt, hsa
uugcuuuugcagaauuuggugcucagacaauauuuaaggacauuucagcgagacaaagugca

SEQ ID NO: 754716 - RNA, 62 nt, hsa
uggacaaaauuaagucuuuaaaauuuaggcacuuuaaggagaacuaauaacuuuuuccaugu

SEQ ID NO: 754717 - RNA, 62 nt, hsa
auggguuuuuguuuuuccuucauuguugagaauuuaaggaccuuugauacugcugcacaaua

SEQ ID NO: 754718 - RNA, 62 nt, hsa
uggguaaaauaacggaucugauuagaaacuguuuuaaggaggggcugggcucgguggcucac

SEQ ID NO: 754719 - RNA, 62 nt, hsa
guccuaguguuugccuucuugguaaaauuacauuuaaggaugucauuucaugagucaaauug

SEQ ID NO: 754720 - RNA, 62 nt, hsa
gggaguucuauuccauuuauucugaugucccuuuuaaggaggaguugguguugaagugugac

SEQ ID NO: 754721 - RNA, 64 nt, hsa; identical to SEQ ID NO: 608660

SEQ ID NO: 754722 - RNA, 64 nt, hsa; identical to SEQ ID NO: 608661

SEQ ID NO: 754723 - RNA, 64 nt, hsa; identical to SEQ ID NO: 608662

SEQ ID NO: 754724 - RNA, 64 nt, hsa; identical to SEQ ID NO: 608663

SEQ ID NO: 754725 - RNA, 64 nt, hsa; identical to SEQ ID NO: 608664

SEQ ID NO: 754726 - RNA, 64 nt, hsa; identical to SEQ ID NO: 608665

SEQ ID NO: 754727 - RNA, 64 nt, hsa; identical to SEQ ID NO: 608666

SEQ ID NO: 754728 - RNA, 64 nt, hsa; identical to SEQ ID NO: 608667

SEQ ID NO: 754729 - RNA, 64 nt, hsa; identical to SEQ ID NO: 608668

SEQ ID NO: 754730 - RNA, 64 nt, hsa; identical to SEQ ID NO: 608669

SEQ ID NO: 754731 - RNA, 64 nt, hsa; identical to SEQ ID NO: 608670

SEQ ID NO: 754732 - RNA, 64 nt, hsa; identical to SEQ ID NO: 608671

SEQ ID NO: 754733 - RNA, 64 nt, hsa; identical to SEQ ID NO: 627326

SEQ ID NO: 754734 - RNA, 64 nt, hsa; identical to SEQ ID NO: 627327

SEQ ID NO: 754735 - RNA, 64 nt, hsa; identical to SEQ ID NO: 627328

SEQ ID NO: 754736 - RNA, 64 nt, hsa; identical to SEQ ID NO: 627329

SEQ ID NO: 754737 - RNA, 64 nt, hsa; identical to SEQ ID NO: 627330

SEQ ID NO: 754738 - RNA, 64 nt, hsa; identical to SEQ ID NO: 627331

SEQ ID NO: 754739 - RNA, 64 nt, hsa; identical to SEQ ID NO: 627332

SEQ ID NO: 754740 - RNA, 64 nt, hsa; identical to SEQ ID NO: 627333

SEQ ID NO: 754741 - RNA, 64 nt, hsa; identical to SEQ ID NO: 627334

SEQ ID NO: 754742 - RNA, 64 nt, hsa; identical to SEQ ID NO: 627335

SEQ ID NO: 754743 - RNA, 64 nt, hsa; identical to SEQ ID NO: 627336

SEQ ID NO: 754744 - RNA, 64 nt, hsa; identical to SEQ ID NO: 627337

SEQ ID NO: 754745 - RNA, 64 nt, hsa; identical to SEQ ID NO: 627338

SEQ ID NO: 754746 - RNA, 64 nt, hsa; identical to SEQ ID NO: 627339

SEQ ID NO: 754747 - RNA, 64 nt, hsa; identical to SEQ ID NO: 627340

SEQ ID NO: 754748 - RNA, 64 nt, hsa; identical to SEQ ID NO: 627341

SEQ ID NO: 754749 - RNA, 64 nt, hsa; identical to SEQ ID NO: 627342

SEQ ID NO: 754750 - RNA, 64 nt, hsa; identical to SEQ ID NO: 627343

SEQ ID NO: 754751 - RNA, 64 nt, hsa; identical to SEQ ID NO: 627344

SEQ ID NO: 754752 - RNA, 64 nt, hsa; identical to SEQ ID NO: 627345

SEQ ID NO: 754753 - RNA, 64 nt, hsa; identical to SEQ ID NO: 627346

SEQ ID NO: 754754 - RNA, 64 nt, hsa; identical to SEQ ID NO: 627347

SEQ ID NO: 754755 - RNA, 64 nt, hsa; identical to SEQ ID NO: 627348

SEQ ID NO: 754756 - RNA, 64 nt, hsa; identical to SEQ ID NO: 627349

SEQ ID NO: 754757 - RNA, 64 nt, hsa; identical to SEQ ID NO: 627350

SEQ ID NO: 754758 - RNA, 64 nt, hsa; identical to SEQ ID NO: 627351

SEQ ID NO: 754759 - RNA, 64 nt, hsa; identical to SEQ ID NO: 627352

SEQ ID NO: 754760 - RNA, 64 nt, hsa; identical to SEQ ID NO: 627353

SEQ ID NO: 754761 - RNA, 64 nt, hsa; identical to SEQ ID NO: 627354

SEQ ID NO: 754762 - RNA, 64 nt, hsa; identical to SEQ ID NO: 627355

SEQ ID NO: 754763 - RNA, 64 nt, hsa; identical to SEQ ID NO: 627356

SEQ ID NO: 754764 - RNA, 64 nt, hsa; identical to SEQ ID NO: 627357

SEQ ID NO: 754765 - RNA, 64 nt, hsa; identical to SEQ ID NO: 627358

SEQ ID NO: 754766 - RNA, 64 nt, hsa; identical to SEQ ID NO: 627359

SEQ ID NO: 754767 - RNA, 59 nt, hsa
cagagcuugaacacgcguagacuggggucccgcccgacgugucuacgucggcugaagag

SEQ ID NO: 754768 - RNA, 54 nt, hsa
aacuaccccaugaggccugaggagccgcccgaaggucgcggugaccuggugccu

SEQ ID NO: 754769 - RNA, 64 nt, hsa
aaggcagcucgguaaaguuucccuccugcuccccccgcccgacuuugacucugaaucagcauuu

SEQ ID NO: 754770 - RNA, 64 nt, hsa
cgccuagagcugugcagccggcucgaacgagaggccgcccgacuugcagaccuagguugagcag

SEQ ID NO: 754771 - RNA, 64 nt, hsa
gcagacccccgcgcacaccagaaccucuggcaagccgcccgacugcaacugcugacccugcaga

SEQ ID NO: 754772 - RNA, 64 nt, hsa
cagccaaaaaguuggagugaaaagacccuggcacccgcccgacaccugcgugagcccuaggauc

SEQ ID NO: 754773 - RNA, 64 nt, hsa
uucacacggcggcuucggaccaacucccucacucccgcccgaggggcaggccucaaagcccgcc

SEQ ID NO: 754774 - RNA, 64 nt, hsa
ggcaccaaacagcccaggacugccgagacucuggccgcccgaaggagccugcuuugguacuaug

SEQ ID NO: 754775 - RNA, 64 nt, hsa
ugcugcucuuuccuggaagcuaagccugucuccaccgcccgaggccugcgccgguggcucccgc

SEQ ID NO: 754776 - RNA, 64 nt, hsa
ucucacaggucggugcgcucgcucuccgcguuccccgcccgacugccgugcaguccauggcuag

SEQ ID NO: 754777 - RNA, 64 nt, hsa
gcucuccaacauccuccacgccuccgccagccucccgcccgaguaccagaaccgcacggagggg

SEQ ID NO: 754778 - RNA, 64 nt, hsa
cuuucccuuaggauagggcuauauuggcaaaaugccgcccgaacagacugcugacaguaaacca

SEQ ID NO: 754779 - RNA, 64 nt, hsa
ucuccaagcggcccccgggcagccccagagcaccccgcccgacucccauuaaccucgagaaccu

SEQ ID NO: 754780 - RNA, 64 nt, hsa
uuucccggagcguggagaggcagugcugcugcucccgcccgaggcucaugacaacucaauaaag

SEQ ID NO: 754781 - RNA, 64 nt, hsa
uccaguuccgggagagcggcugcccgacucagguccgcccgaccaggaucagccccgcuccucc

SEQ ID NO: 754782 - RNA, 64 nt, hsa
uuccauuucugcagcuuagcuuguguccugcccuccgcccgaggcaaaacguauccugaggacu

SEQ ID NO: 754783 - RNA, 64 nt, hsa
agcaacucaguuguaacuuggggaaguuaacgauccgcccgagugcagaggaaaaccagaaacg

SEQ ID NO: 754784 - RNA, 64 nt, hsa
gucgcccgcgcccgggaacccugacgcucagcucccgcccgacggcagcgccgccgccgcccag

SEQ ID NO: 754785 - RNA, 64 nt, hsa
uaccaggugcucugaggggaugguggccgcccacccgcccgagggauggugccccuaggguccc

SEQ ID NO: 754786 - RNA, 64 nt, hsa
aaguccguguccuaccuccgucuucgccaaggccccgcccgagccuaguuguucucccccugaa

SEQ ID NO: 754787 - RNA, 64 nt, hsa
cccuaacauaaguuuucacuguggugggauggugccgcccgauaugcuugauaugcuuuuccuu

SEQ ID NO: 754788 - RNA, 64 nt, hsa
cgccucuuauuuaugaagucuuugaccgucccccccgcccgaccccaccgcccucccgccccca

SEQ ID NO: 754789 - RNA, 64 nt, hsa
gccugucauccauggggccauugcaggcacucugccgcccgaccuugagggcugugccaauccu

SEQ ID NO: 754790 - RNA, 64 nt, hsa
acggcugcugcggaaaggaaacccccuccccgacccgcccgacggccucaggccccgccuccaa

SEQ ID NO: 754791 - RNA, 64 nt, hsa
gaugcugagcauguaccgcaggccagggcaggccccgcccgaccaggaggcccugcagguaaua

SEQ ID NO: 754792 - RNA, 64 nt, hsa
gggcagcuccggccaggccuuguaggaaaaggccccgcccgagguuccagcgucaacggccacu

SEQ ID NO: 754793 - RNA, 64 nt, hsa
gcgggcgcagggacccaacccggugucgcugcacccgcccgagccccgcuccucgcagccgccu

SEQ ID NO: 754794 - RNA, 64 nt, hsa
ccugacgggagucgcggccccaccgaggcgucggccgcccgaagagccucccaagccagcgcgg

SEQ ID NO: 754795 - RNA, 64 nt, hsa
cuugccuuagaaaaggagaaaggaauuccuuuucccgcccgaacaugaagaaaaaugaccugac

SEQ ID NO: 754796 - RNA, 64 nt, hsa
gccccacuauuucuagcuccacaaguguguggccccgcccgagccccugcccacgcccuuggag

SEQ ID NO: 754797 - RNA, 64 nt, hsa
ggagagcugagccgcgggcagccaggcccagcccccgcccgagcucaggcugccccucuccuuc

SEQ ID NO: 754798 - RNA, 64 nt, hsa
ccccaccccaugacuauugugcgauucgugagcgccgcccgagcggaguugguaacuuguuggg

SEQ ID NO: 754799 - RNA, 64 nt, hsa
uuccuuuauagcgaagcaaaaaacacaagacccuccgcccgaguaaauucuucagccacgaagg

SEQ ID NO: 754800 - RNA, 64 nt, hsa
uguuccuuccucugaaucgaauggaugugggugaccgcccgaaggccuucacaggauggaagua

SEQ ID NO: 754801 - RNA, 64 nt, hsa
cuuggagagacugucauggaagaggguggagccgccgcccgaagcgccgaggaggcugagccac

SEQ ID NO: 754802 - RNA, 64 nt, hsa
gaccgcguuccucagccuccucuccuaggucccuccgcccgacaguugugcuuuguugugguug

SEQ ID NO: 754803 - RNA, 64 nt, hsa
gggccagguauagaaaccgcagugggccugcaagccgcccgagccuccccagcagccuccuaca

SEQ ID NO: 754804 - RNA, 64 nt, hsa
cauugcugcuccuuagcugccaagccccauccugccgcccgagguggcugccuggagccccacu

SEQ ID NO: 754805 - RNA, 64 nt, hsa
cacguugcacacgcagucugcagagccgccgccgccgcccgaaccagcccggaucugagggccc

SEQ ID NO: 754806 - RNA, 64 nt, hsa
accuccacccccgccacggccacccuccuucccgccgcccgaccccgagucgggaggacuccgg

SEQ ID NO: 754807 - RNA, 64 nt, hsa
gccggugacacggccgcaccugccccaaagcgggccgcccgagcguccacuccaagccugagca

SEQ ID NO: 754808 - RNA, 64 nt, hsa; identical to SEQ ID NO: 147964

SEQ ID NO: 754809 - RNA, 64 nt, hsa; identical to SEQ ID NO: 147965

SEQ ID NO: 754810 - RNA, 64 nt, hsa; identical to SEQ ID NO: 147966

SEQ ID NO: 754811 - RNA, 64 nt, hsa; identical to SEQ ID NO: 147967

SEQ ID NO: 754812 - RNA, 64 nt, hsa; identical to SEQ ID NO: 147968

SEQ ID NO: 754813 - RNA, 64 nt, hsa; identical to SEQ ID NO: 147969

SEQ ID NO: 754814 - RNA, 64 nt, hsa; identical to SEQ ID NO: 147970

SEQ ID NO: 754815 - RNA, 64 nt, hsa; identical to SEQ ID NO: 147971

SEQ ID NO: 754816 - RNA, 64 nt, hsa; identical to SEQ ID NO: 147972

SEQ ID NO: 754817 - RNA, 64 nt, hsa; identical to SEQ ID NO: 128601

SEQ ID NO: 754818 - RNA, 64 nt, hsa; identical to SEQ ID NO: 128602

SEQ ID NO: 754819 - RNA, 64 nt, hsa; identical to SEQ ID NO: 128603

SEQ ID NO: 754820 - RNA, 64 nt, hsa; identical to SEQ ID NO: 128604

SEQ ID NO: 754821 - RNA, 64 nt, hsa; identical to SEQ ID NO: 128605

SEQ ID NO: 754822 - RNA, 64 nt, hsa; identical to SEQ ID NO: 128606

SEQ ID NO: 754823 - RNA, 64 nt, hsa; identical to SEQ ID NO: 128607

SEQ ID NO: 754824 - RNA, 64 nt, hsa; identical to SEQ ID NO: 128608

SEQ ID NO: 754825 - RNA, 64 nt, hsa; identical to SEQ ID NO: 128609

SEQ ID NO: 754826 - RNA, 64 nt, hsa; identical to SEQ ID NO: 128610

SEQ ID NO: 754827 - RNA, 64 nt, hsa; identical to SEQ ID NO: 128611

SEQ ID NO: 754828 - RNA, 64 nt, hsa; identical to SEQ ID NO: 128612

SEQ ID NO: 754829 - RNA, 64 nt, hsa; identical to SEQ ID NO: 128613

SEQ ID NO: 754830 - RNA, 64 nt, hsa; identical to SEQ ID NO: 128614

SEQ ID NO: 754831 - RNA, 64 nt, hsa; identical to SEQ ID NO: 128615

SEQ ID NO: 754832 - RNA, 64 nt, hsa; identical to SEQ ID NO: 128616

SEQ ID NO: 754833 - RNA, 64 nt, hsa; identical to SEQ ID NO: 128617

SEQ ID NO: 754834 - RNA, 64 nt, hsa; identical to SEQ ID NO: 128618

SEQ ID NO: 754835 - RNA, 64 nt, hsa; identical to SEQ ID NO: 128619

SEQ ID NO: 754836 - RNA, 64 nt, hsa; identical to SEQ ID NO: 128620

SEQ ID NO: 754837 - RNA, 64 nt, hsa; identical to SEQ ID NO: 128621

SEQ ID NO: 754838 - RNA, 64 nt, hsa; identical to SEQ ID NO: 128622

SEQ ID NO: 754839 - RNA, 64 nt, hsa; identical to SEQ ID NO: 128623

SEQ ID NO: 754840 - RNA, 64 nt, hsa; identical to SEQ ID NO: 128624

SEQ ID NO: 754841 - RNA, 64 nt, hsa; identical to SEQ ID NO: 128625

SEQ ID NO: 754842 - RNA, 64 nt, hsa; identical to SEQ ID NO: 128626

SEQ ID NO: 754843 - RNA, 64 nt, hsa; identical to SEQ ID NO: 128627

SEQ ID NO: 754844 - RNA, 64 nt, hsa; identical to SEQ ID NO: 128628

SEQ ID NO: 754845 - RNA, 64 nt, hsa; identical to SEQ ID NO: 128629

SEQ ID NO: 754846 - RNA, 64 nt, hsa; identical to SEQ ID NO: 128630

SEQ ID NO: 754847 - RNA, 64 nt, hsa; identical to SEQ ID NO: 128631

SEQ ID NO: 754848 - RNA, 64 nt, hsa; identical to SEQ ID NO: 128632

SEQ ID NO: 754849 - RNA, 64 nt, hsa; identical to SEQ ID NO: 128633

SEQ ID NO: 754850 - RNA, 64 nt, hsa; identical to SEQ ID NO: 128634

SEQ ID NO: 754851 - RNA, 64 nt, hsa; identical to SEQ ID NO: 128635

SEQ ID NO: 754852 - RNA, 64 nt, hsa; identical to SEQ ID NO: 128636

SEQ ID NO: 754853 - RNA, 64 nt, hsa; identical to SEQ ID NO: 128637

SEQ ID NO: 754854 - RNA, 64 nt, hsa; identical to SEQ ID NO: 128638

SEQ ID NO: 754855 - RNA, 64 nt, hsa; identical to SEQ ID NO: 128639

SEQ ID NO: 754856 - RNA, 64 nt, hsa; identical to SEQ ID NO: 128640

SEQ ID NO: 754857 - RNA, 64 nt, hsa; identical to SEQ ID NO: 128641

SEQ ID NO: 754858 - RNA, 64 nt, hsa; identical to SEQ ID NO: 128642

SEQ ID NO: 754859 - RNA, 64 nt, hsa; identical to SEQ ID NO: 128643

SEQ ID NO: 754860 - RNA, 64 nt, hsa; identical to SEQ ID NO: 128644

SEQ ID NO: 754861 - RNA, 64 nt, hsa; identical to SEQ ID NO: 128645

SEQ ID NO: 754862 - RNA, 64 nt, hsa; identical to SEQ ID NO: 128646

SEQ ID NO: 754863 - RNA, 64 nt, hsa; identical to SEQ ID NO: 128647

SEQ ID NO: 754864 - RNA, 64 nt, hsa; identical to SEQ ID NO: 697595

SEQ ID NO: 754865 - RNA, 64 nt, hsa; identical to SEQ ID NO: 697596

SEQ ID NO: 754866 - RNA, 64 nt, hsa; identical to SEQ ID NO: 697597

SEQ ID NO: 754867 - RNA, 64 nt, hsa; identical to SEQ ID NO: 697598

SEQ ID NO: 754868 - RNA, 64 nt, hsa; identical to SEQ ID NO: 697599

SEQ ID NO: 754869 - RNA, 64 nt, hsa; identical to SEQ ID NO: 697600

SEQ ID NO: 754870 - RNA, 64 nt, hsa; identical to SEQ ID NO: 697601

SEQ ID NO: 754871 - RNA, 64 nt, hsa; identical to SEQ ID NO: 697602

SEQ ID NO: 754872 - RNA, 64 nt, hsa; identical to SEQ ID NO: 697603

SEQ ID NO: 754873 - RNA, 64 nt, hsa; identical to SEQ ID NO: 697604

SEQ ID NO: 754874 - RNA, 64 nt, hsa; identical to SEQ ID NO: 697605

SEQ ID NO: 754875 - RNA, 64 nt, hsa; identical to SEQ ID NO: 697606

SEQ ID NO: 754876 - RNA, 64 nt, hsa; identical to SEQ ID NO: 697607

SEQ ID NO: 754877 - RNA, 64 nt, hsa; identical to SEQ ID NO: 697608

SEQ ID NO: 754878 - RNA, 64 nt, hsa; identical to SEQ ID NO: 697609

SEQ ID NO: 754879 - RNA, 64 nt, hsa; identical to SEQ ID NO: 697610

SEQ ID NO: 754880 - RNA, 64 nt, hsa; identical to SEQ ID NO: 697611

SEQ ID NO: 754881 - RNA, 64 nt, hsa; identical to SEQ ID NO: 697612

SEQ ID NO: 754882 - RNA, 64 nt, hsa; identical to SEQ ID NO: 697613

SEQ ID NO: 754883 - RNA, 64 nt, hsa; identical to SEQ ID NO: 697614

SEQ ID NO: 754884 - RNA, 64 nt, hsa; identical to SEQ ID NO: 697615

SEQ ID NO: 754885 - RNA, 64 nt, hsa; identical to SEQ ID NO: 697616

SEQ ID NO: 754886 - RNA, 64 nt, hsa; identical to SEQ ID NO: 697617

SEQ ID NO: 754887 - RNA, 64 nt, hsa; identical to SEQ ID NO: 697618

SEQ ID NO: 754888 - RNA, 64 nt, hsa; identical to SEQ ID NO: 697619

SEQ ID NO: 754889 - RNA, 64 nt, hsa; identical to SEQ ID NO: 697620

SEQ ID NO: 754890 - RNA, 64 nt, hsa; identical to SEQ ID NO: 697621

SEQ ID NO: 754891 - RNA, 64 nt, hsa; identical to SEQ ID NO: 697622

SEQ ID NO: 754892 - RNA, 64 nt, hsa; identical to SEQ ID NO: 697623

SEQ ID NO: 754893 - RNA, 64 nt, hsa; identical to SEQ ID NO: 697624

SEQ ID NO: 754894 - RNA, 64 nt, hsa; identical to SEQ ID NO: 697625

SEQ ID NO: 754895 - RNA, 64 nt, hsa; identical to SEQ ID NO: 153734

SEQ ID NO: 754896 - RNA, 64 nt, hsa; identical to SEQ ID NO: 153735

SEQ ID NO: 754897 - RNA, 64 nt, hsa; identical to SEQ ID NO: 153736

SEQ ID NO: 754898 - RNA, 64 nt, hsa; identical to SEQ ID NO: 153737

SEQ ID NO: 754899 - RNA, 64 nt, hsa; identical to SEQ ID NO: 153738

SEQ ID NO: 754900 - RNA, 64 nt, hsa; identical to SEQ ID NO: 153739

SEQ ID NO: 754901 - RNA, 64 nt, hsa; identical to SEQ ID NO: 153740

SEQ ID NO: 754902 - RNA, 64 nt, hsa; identical to SEQ ID NO: 153741

SEQ ID NO: 754903 - RNA, 64 nt, hsa; identical to SEQ ID NO: 153742

SEQ ID NO: 754904 - RNA, 64 nt, hsa; identical to SEQ ID NO: 153743

SEQ ID NO: 754905 - RNA, 64 nt, hsa; identical to SEQ ID NO: 153744

SEQ ID NO: 754906 - RNA, 64 nt, hsa; identical to SEQ ID NO: 153745

SEQ ID NO: 754907 - RNA, 64 nt, hsa; identical to SEQ ID NO: 153746

SEQ ID NO: 754908 - RNA, 64 nt, hsa; identical to SEQ ID NO: 153747

SEQ ID NO: 754909 - RNA, 64 nt, hsa; identical to SEQ ID NO: 153748

SEQ ID NO: 754910 - RNA, 64 nt, hsa; identical to SEQ ID NO: 153749

SEQ ID NO: 754911 - RNA, 64 nt, hsa; identical to SEQ ID NO: 153750

SEQ ID NO: 754912 - RNA, 64 nt, hsa; identical to SEQ ID NO: 153751

SEQ ID NO: 754913 - RNA, 64 nt, hsa; identical to SEQ ID NO: 153752

SEQ ID NO: 754914 - RNA, 64 nt, hsa; identical to SEQ ID NO: 153753

SEQ ID NO: 754915 - RNA, 64 nt, hsa; identical to SEQ ID NO: 153754

SEQ ID NO: 754916 - RNA, 64 nt, hsa; identical to SEQ ID NO: 153755

SEQ ID NO: 754917 - RNA, 64 nt, hsa; identical to SEQ ID NO: 153756

SEQ ID NO: 754918 - RNA, 64 nt, hsa; identical to SEQ ID NO: 153757

SEQ ID NO: 754919 - RNA, 64 nt, hsa; identical to SEQ ID NO: 153758

SEQ ID NO: 754920 - RNA, 64 nt, hsa; identical to SEQ ID NO: 153759

SEQ ID NO: 754921 - RNA, 64 nt, hsa; identical to SEQ ID NO: 153760

SEQ ID NO: 754922 - RNA, 64 nt, hsa; identical to SEQ ID NO: 153761

SEQ ID NO: 754923 - RNA, 64 nt, hsa; identical to SEQ ID NO: 153762

SEQ ID NO: 754924 - RNA, 64 nt, hsa; identical to SEQ ID NO: 153763

SEQ ID NO: 754925 - RNA, 64 nt, hsa; identical to SEQ ID NO: 153764

SEQ ID NO: 754926 - RNA, 64 nt, hsa; identical to SEQ ID NO: 153765

SEQ ID NO: 754927 - RNA, 64 nt, hsa; identical to SEQ ID NO: 153766

SEQ ID NO: 754928 - RNA, 64 nt, hsa; identical to SEQ ID NO: 153767

SEQ ID NO: 754929 - RNA, 64 nt, hsa; identical to SEQ ID NO: 153768

SEQ ID NO: 754930 - RNA, 64 nt, hsa; identical to SEQ ID NO: 153769

SEQ ID NO: 754931 - RNA, 64 nt, hsa; identical to SEQ ID NO: 153770

SEQ ID NO: 754932 - RNA, 64 nt, hsa; identical to SEQ ID NO: 153771

SEQ ID NO: 754933 - RNA, 64 nt, hsa; identical to SEQ ID NO: 153772

SEQ ID NO: 754934 - RNA, 64 nt, hsa; identical to SEQ ID NO: 153773

SEQ ID NO: 754935 - RNA, 64 nt, hsa; identical to SEQ ID NO: 153774

SEQ ID NO: 754936 - RNA, 64 nt, hsa; identical to SEQ ID NO: 153775

SEQ ID NO: 754937 - RNA, 64 nt, hsa; identical to SEQ ID NO: 153776

SEQ ID NO: 754938 - RNA, 64 nt, hsa; identical to SEQ ID NO: 153777

SEQ ID NO: 754939 - RNA, 64 nt, hsa; identical to SEQ ID NO: 153778

SEQ ID NO: 754940 - RNA, 64 nt, hsa; identical to SEQ ID NO: 153779

SEQ ID NO: 754941 - RNA, 64 nt, hsa; identical to SEQ ID NO: 153780

SEQ ID NO: 754942 - RNA, 64 nt, hsa; identical to SEQ ID NO: 153781

SEQ ID NO: 754943 - RNA, 64 nt, hsa; identical to SEQ ID NO: 153782

SEQ ID NO: 754944 - RNA, 64 nt, hsa; identical to SEQ ID NO: 153783

SEQ ID NO: 754945 - RNA, 64 nt, hsa; identical to SEQ ID NO: 153784

SEQ ID NO: 754946 - RNA, 64 nt, hsa; identical to SEQ ID NO: 153785

SEQ ID NO: 754947 - RNA, 64 nt, hsa; identical to SEQ ID NO: 153786

SEQ ID NO: 754948 - RNA, 64 nt, hsa; identical to SEQ ID NO: 153787

SEQ ID NO: 754949 - RNA, 64 nt, hsa; identical to SEQ ID NO: 153788

SEQ ID NO: 754950 - RNA, 64 nt, hsa; identical to SEQ ID NO: 153789

SEQ ID NO: 754951 - RNA, 64 nt, hsa; identical to SEQ ID NO: 153790

SEQ ID NO: 754952 - RNA, 64 nt, hsa; identical to SEQ ID NO: 153791

SEQ ID NO: 754953 - RNA, 64 nt, hsa; identical to SEQ ID NO: 153792

SEQ ID NO: 754954 - RNA, 64 nt, hsa; identical to SEQ ID NO: 153793

SEQ ID NO: 754955 - RNA, 64 nt, hsa; identical to SEQ ID NO: 153794

SEQ ID NO: 754956 - RNA, 64 nt, hsa; identical to SEQ ID NO: 153795

SEQ ID NO: 754957 - RNA, 64 nt, hsa; identical to SEQ ID NO: 153796

SEQ ID NO: 754958 - RNA, 64 nt, hsa; identical to SEQ ID NO: 153797

SEQ ID NO: 754959 - RNA, 64 nt, hsa; identical to SEQ ID NO: 153798

SEQ ID NO: 754960 - RNA, 64 nt, hsa; identical to SEQ ID NO: 153799

SEQ ID NO: 754961 - RNA, 64 nt, hsa; identical to SEQ ID NO: 153800

SEQ ID NO: 754962 - RNA, 64 nt, hsa; identical to SEQ ID NO: 153801

SEQ ID NO: 754963 - RNA, 64 nt, hsa; identical to SEQ ID NO: 153802

SEQ ID NO: 754964 - RNA, 64 nt, hsa; identical to SEQ ID NO: 153803

SEQ ID NO: 754965 - RNA, 64 nt, hsa; identical to SEQ ID NO: 153804

SEQ ID NO: 754966 - RNA, 64 nt, hsa; identical to SEQ ID NO: 153805

SEQ ID NO: 754967 - RNA, 64 nt, hsa; identical to SEQ ID NO: 153806

SEQ ID NO: 754968 - RNA, 64 nt, hsa; identical to SEQ ID NO: 153807

SEQ ID NO: 754969 - RNA, 64 nt, hsa; identical to SEQ ID NO: 153808

SEQ ID NO: 754970 - RNA, 64 nt, hsa; identical to SEQ ID NO: 153809

SEQ ID NO: 754971 - RNA, 64 nt, hsa; identical to SEQ ID NO: 153810

SEQ ID NO: 754972 - RNA, 64 nt, hsa; identical to SEQ ID NO: 153811

SEQ ID NO: 754973 - RNA, 64 nt, hsa; identical to SEQ ID NO: 153812

SEQ ID NO: 754974 - RNA, 64 nt, hsa; identical to SEQ ID NO: 153813

SEQ ID NO: 754975 - RNA, 64 nt, hsa; identical to SEQ ID NO: 153814

SEQ ID NO: 754976 - RNA, 64 nt, hsa; identical to SEQ ID NO: 153815

SEQ ID NO: 754977 - RNA, 64 nt, hsa; identical to SEQ ID NO: 153816

SEQ ID NO: 754978 - RNA, 64 nt, hsa; identical to SEQ ID NO: 153817

SEQ ID NO: 754979 - RNA, 64 nt, hsa; identical to SEQ ID NO: 153818

SEQ ID NO: 754980 - RNA, 64 nt, hsa; identical to SEQ ID NO: 153819

SEQ ID NO: 754981 - RNA, 64 nt, hsa; identical to SEQ ID NO: 153820

SEQ ID NO: 754982 - RNA, 64 nt, hsa; identical to SEQ ID NO: 153821

SEQ ID NO: 754983 - RNA, 64 nt, hsa; identical to SEQ ID NO: 153822

SEQ ID NO: 754984 - RNA, 64 nt, hsa; identical to SEQ ID NO: 153823

SEQ ID NO: 754985 - RNA, 64 nt, hsa; identical to SEQ ID NO: 153824

SEQ ID NO: 754986 - RNA, 64 nt, hsa; identical to SEQ ID NO: 153825

SEQ ID NO: 754987 - RNA, 64 nt, hsa; identical to SEQ ID NO: 153826

SEQ ID NO: 754988 - RNA, 64 nt, hsa; identical to SEQ ID NO: 153827

SEQ ID NO: 754989 - RNA, 64 nt, hsa; identical to SEQ ID NO: 153828

SEQ ID NO: 754990 - RNA, 64 nt, hsa; identical to SEQ ID NO: 153829

SEQ ID NO: 754991 - RNA, 64 nt, hsa; identical to SEQ ID NO: 153830

SEQ ID NO: 754992 - RNA, 64 nt, hsa; identical to SEQ ID NO: 153831

SEQ ID NO: 754993 - RNA, 64 nt, hsa; identical to SEQ ID NO: 153832

SEQ ID NO: 754994 - RNA, 64 nt, hsa; identical to SEQ ID NO: 153833

SEQ ID NO: 754995 - RNA, 64 nt, hsa; identical to SEQ ID NO: 153834

SEQ ID NO: 754996 - RNA, 64 nt, hsa; identical to SEQ ID NO: 153835

SEQ ID NO: 754997 - RNA, 64 nt, hsa; identical to SEQ ID NO: 153836

SEQ ID NO: 754998 - RNA, 64 nt, hsa; identical to SEQ ID NO: 153837

SEQ ID NO: 754999 - RNA, 64 nt, hsa; identical to SEQ ID NO: 153838

SEQ ID NO: 755000 - RNA, 64 nt, hsa; identical to SEQ ID NO: 153839

SEQ ID NO: 755001 - RNA, 64 nt, hsa; identical to SEQ ID NO: 153840

SEQ ID NO: 755002 - RNA, 64 nt, hsa; identical to SEQ ID NO: 153841

SEQ ID NO: 755003 - RNA, 64 nt, hsa; identical to SEQ ID NO: 153842

SEQ ID NO: 755004 - RNA, 64 nt, hsa; identical to SEQ ID NO: 153843

SEQ ID NO: 755005 - RNA, 64 nt, hsa; identical to SEQ ID NO: 153844

SEQ ID NO: 755006 - RNA, 64 nt, hsa; identical to SEQ ID NO: 153845

SEQ ID NO: 755007 - RNA, 64 nt, hsa; identical to SEQ ID NO: 153846

SEQ ID NO: 755008 - RNA, 64 nt, hsa
agaacuaagaaugccaagguuuuauauauguguguauauauauauauauauauauauauauaug

SEQ ID NO: 755009 - RNA, 64 nt, hsa
aacuaagaaugccaagguuuuauauauguguguauauauauauauauauauauauauauauguu

SEQ ID NO: 755010 - RNA, 64 nt, hsa
cuaagaaugccaagguuuuauauauguguguauauauauauauauauauauauauauauguuug

SEQ ID NO: 755011 - RNA, 64 nt, hsa
aagaaugccaagguuuuauauauguguguauauauauauauauauauauauauauauguuugug

SEQ ID NO: 755012 - RNA, 64 nt, hsa
gaaugccaagguuuuauauauguguguauauauauauauauauauauauauauauguuugugug

SEQ ID NO: 755013 - RNA, 64 nt, hsa
augccaagguuuuauauauguguguauauauauauauauauauauauauauauguuugugugug

SEQ ID NO: 755014 - RNA, 64 nt, hsa
gccaagguuuuauauauguguguauauauauauauauauauauauauauauguuugugugugua

SEQ ID NO: 755015 - RNA, 64 nt, hsa
caagguuuuauauauguguguauauauauauauauauauauauauauauguuuguguguguaua

SEQ ID NO: 755016 - RNA, 64 nt, hsa
uguguguguauauauauauauauauauauauauauauauauauauauguuuguguguguauaua

SEQ ID NO: 755017 - RNA, 64 nt, hsa
uguguguauauauauauauauauauauauauauauauauauauauguuuguguguguauauaua

SEQ ID NO: 755018 - RNA, 64 nt, hsa
uguguauauauauauauauauauauauauauauauauauauauguuuguguguguauauauaua

SEQ ID NO: 755019 - RNA, 64 nt, hsa
uauauauauauauauauauauauguuuguguguguauauauauauauauauauauauguuugug

SEQ ID NO: 755020 - RNA, 64 nt, hsa
uauauauauauauauauauauguuuguguguguauauauauauauauauauauauguuugugug

SEQ ID NO: 755021 - RNA, 64 nt, hsa
uauauauauauauauauauguuuguguguguauauauauauauauauauauauguuugugugug

SEQ ID NO: 755022 - RNA, 64 nt, hsa
uauauauauauauauauguuuguguguguauauauauauauauauauauauguuugugugugua

SEQ ID NO: 755023 - RNA, 64 nt, hsa
uauauauauauauauguuuguguguguauauauauauauauauauauauguuuguguguguaua

SEQ ID NO: 755024 - RNA, 64 nt, hsa
uauauauauauauguuuguguguguauauauauauauauauauauauguuuguguguguauaua

SEQ ID NO: 755025 - RNA, 64 nt, hsa
uauauauauauguuuguguguguauauauauauauauauauauauguuuguguguguauauaua

SEQ ID NO: 755026 - RNA, 64 nt, hsa
uauauauauguuuguguguguauauauauauauauauauauauguuuguguguguauauauaug

SEQ ID NO: 755027 - RNA, 64 nt, hsa
uauauauauauauauauauauauguuuguguguguauauauauguuuguguauauauauacaca

SEQ ID NO: 755028 - RNA, 64 nt, hsa
uauauauguuuguguguguauauauauguuuguguauauauauacacauaugcauacauaugau

SEQ ID NO: 755029 - RNA, 64 nt, hsa
uauauguuuguguguguauauauauguuuguguauauauauacacauaugcauacauaugauuu

SEQ ID NO: 755030 - RNA, 64 nt, hsa
acaauagaugacuuuauuuguuuaaaauguuuaauauauauacauacauauauauauauuuguc

SEQ ID NO: 755031 - RNA, 64 nt, hsa
uauuuguuuaaaauguuuaauauauauacauacauauauauauauuugucuguaagaauuaugu

SEQ ID NO: 755032 - RNA, 64 nt, hsa
uuuguuuaaaauguuuaauauauauacauacauauauauauauuugucuguaagaauuauguuu

SEQ ID NO: 755033 - RNA, 64 nt, hsa
cucuuggugggauaugcagaacuugggauguguguauauauaaauauauaauauauauaaauau

SEQ ID NO: 755034 - RNA, 64 nt, hsa
agaacuugggauguguguauauauaaauauauaauauauauaaauauauauaauacugacuuaa

SEQ ID NO: 755035 - RNA, 64 nt, hsa
auguguguauauauaaauauauaauauauauaaauauauauaauacugacuuaaaaaaucaaau

SEQ ID NO: 755036 - RNA, 64 nt, hsa
uuguauacauuucuuauuuacgauuuucauuuguuauauauauauauaaauauacuguauauau

SEQ ID NO: 755037 - RNA, 64 nt, hsa
guauacauuucuuauuuacgauuuucauuuguuauauauauauauaaauauacuguauauauau

SEQ ID NO: 755038 - RNA, 64 nt, hsa
auacauuucuuauuuacgauuuucauuuguuauauauauauauaaauauacuguauauauaugc

SEQ ID NO: 755039 - RNA, 64 nt, hsa
acauuucuuauuuacgauuuucauuuguuauauauauauauaaauauacuguauauauaugcaa

SEQ ID NO: 755040 - RNA, 64 nt, hsa
uuuucauuuguuauauauauauauaaauauacuguauauauaugcaacauuuuauauuuuucau

SEQ ID NO: 755041 - RNA, 64 nt, hsa
ucauauaaucucgggauacacacacacacacacauauauauacacacacauacguauacacaca

SEQ ID NO: 755042 - RNA, 64 nt, hsa
uauauacacacacauacguauacacacacauacauauauauaaauauaccugaugccagauuuu

SEQ ID NO: 755043 - RNA, 64 nt, hsa
acgaauccugaaaauuaugcuagcaugauuuuuuuauauauagaaguuuaaaaauaaaccaggu

SEQ ID NO: 755044 - RNA, 64 nt, hsa
uuguuugaaugaugcauguuauugacaaggcaaauauauauauauacacagucuguuucuucua

SEQ ID NO: 755045 - RNA, 64 nt, hsa
guuugaaugaugcauguuauugacaaggcaaauauauauauauacacagucuguuucuucuauu

SEQ ID NO: 755046 - RNA, 64 nt, hsa
uugaaugaugcauguuauugacaaggcaaauauauauauauacacagucuguuucuucuauucc

SEQ ID NO: 755047 - RNA, 64 nt, hsa
aauuuuaaagauaauguuauguguguaugugaaauauauauacauauauauauauauguuuauu

SEQ ID NO: 755048 - RNA, 64 nt, hsa
auaauguuauguguguaugugaaauauauauacauauauauauauauguuuauuuccuaaaaga

SEQ ID NO: 755049 - RNA, 64 nt, hsa
aauguuauguguguaugugaaauauauauacauauauauauauauguuuauuuccuaaaagaag

SEQ ID NO: 755050 - RNA, 64 nt, hsa
uguuauguguguaugugaaauauauauacauauauauauauauuuccuaaaagaagaaaagaua

SEQ ID NO: 755051 - RNA, 64 nt, hsa
aauuaucuuuuuaaaguaaauaaaauuaugaaaauauauauaguauauauaaaguacuguguuu

SEQ ID NO: 755052 - RNA, 64 nt, hsa
uuuaaaguaaauaaaauuaugaaaauauauauaguauauauaaaguacuguguuuaaaaaaaug

SEQ ID NO: 755053 - RNA, 64 nt, hsa
uguguguguauguguauguguauguacacauacauauauauaguugacacuugaaaaaugcagg

SEQ ID NO: 755054 - RNA, 64 nt, hsa
agccuguuauugacugggagccugacugauguauuauauauauuguauacuguauucuuaaagu

SEQ ID NO: 755055 - RNA, 64 nt, hsa
cuguucagacauauauauguauguauguaaaaauuauauauacacaaauuagcugcacguauau

SEQ ID NO: 755056 - RNA, 64 nt, hsa
uuauauauacacaaauuagcugcacguauauacauauauauauuucuuuuuaaauuucauauug

SEQ ID NO: 755057 - RNA, 64 nt, hsa
uugcccaggaaauggguugauucaucacagauuuuauauauauacuuuuuuuuaacuaagugug

SEQ ID NO: 755058 - RNA, 64 nt, hsa
gcccaggaaauggguugauucaucacagauuuuauauauauacuuuuuuuuaacuaagugugag

SEQ ID NO: 755059 - RNA, 64 nt, hsa
uuuuuucauauuuuguuugucuauauuauauaaauauauauauacaguuauauauauauauauu

SEQ ID NO: 755060 - RNA, 64 nt, hsa
uuuucauauuuuguuugucuauauuauauaaauauauauauacaguuauauauauauauauuau

SEQ ID NO: 755061 - RNA, 64 nt, hsa
guuugucuauauuauauaaauauauauauacaguuauauauauauauauuauuuuuugguucuc

SEQ ID NO: 755062 - RNA, 64 nt, hsa
uugucuauauuauauaaauauauauauacaguuauauauauauauauuauuuuuugguucucuc

SEQ ID NO: 755063 - RNA, 64 nt, hsa
gucuauauuauauaaauauauauauacaguuauauauauauauauuauuuuuugguucucucuc

SEQ ID NO: 755064 - RNA, 64 nt, hsa
cuauauuauauaaauauauauauacaguuauauauauauauauuauuuuuugguucucucucgu

SEQ ID NO: 755065 - RNA, 64 nt, hsa
uguuuuugucuuuuuccuuuauucuuuuuguaaauauauauauaaugaguuucauuaaaauaga

SEQ ID NO: 755066 - RNA, 64 nt, hsa
uuuuugucuuuuuccuuuauucuuuuuguaaauauauauauaaugaguuucauuaaaauagauu

SEQ ID NO: 755067 - RNA, 64 nt, hsa
gcgagacccugucucaaaauauguauauauuuaauauauauauaaaaccagagcugacaaugac

SEQ ID NO: 755068 - RNA, 64 nt, hsa
gagacccugucucaaaauauguauauauuuaauauauauauaaaaccagagcugacaaugacac

SEQ ID NO: 755069 - RNA, 64 nt, hsa
aaguuuuaaaaaaaacuacagcagccaaagaaacuauauauauauauauauauauauauaucca

SEQ ID NO: 755070 - RNA, 64 nt, hsa
guuuuaaaaaaaacuacagcagccaaagaaacuauauauauauauauauauauauauauccaga

SEQ ID NO: 755071 - RNA, 64 nt, hsa
uuuaaaaaaaacuacagcagccaaagaaacuauauauauauauauauauauauauauccagaau

SEQ ID NO: 755072 - RNA, 64 nt, hsa
uaaaaaaaacuacagcagccaaagaaacuauauauauauauauauauauauauauccagaauga

SEQ ID NO: 755073 - RNA, 64 nt, hsa
aaaaaaacuacagcagccaaagaaacuauauauauauauauauauauauauauccagaaugauu

SEQ ID NO: 755074 - RNA, 64 nt, hsa
aaaaacuacagcagccaaagaaacuauauauauauauauauauauauauauccagaaugauugc

SEQ ID NO: 755075 - RNA, 64 nt, hsa
aaacuacagcagccaaagaaacuauauauauauauauauauauauauauccagaaugauugccu

SEQ ID NO: 755076 - RNA, 64 nt, hsa
acuacagcagccaaagaaacuauauauauauauauauauauauauauccagaaugauugccucu

SEQ ID NO: 755077 - RNA, 64 nt, hsa
uacagcagccaaagaaacuauauauauauauauauauauauauauccagaaugauugccucuac

SEQ ID NO: 755078 - RNA, 64 nt, hsa
cagcagccaaagaaacuauauauauauauauauauauauauauccagaaugauugccucuacug

SEQ ID NO: 755079 - RNA, 64 nt, hsa
ucuuucgugccuuaaggauagugagaugcacacuuauauauauacuguauauauuuauauauuu

SEQ ID NO: 755080 - RNA, 64 nt, hsa
uuucgugccuuaaggauagugagaugcacacuuauauauauacuguauauauuuauauauuuau

SEQ ID NO: 755081 - RNA, 64 nt, hsa
acacuuauauauauacuguauauauuuauauauuuauauauauauuucauauauauauauaaua

SEQ ID NO: 755082 - RNA, 64 nt, hsa
acuuauauauauacuguauauauuuauauauuuauauauauauuucauauauauauauaauauu

SEQ ID NO: 755083 - RNA, 64 nt, hsa
cuguauauauuuauauauuuauauauauauuucauauauauauauaauauugcaagcuuaaguu

SEQ ID NO: 755084 - RNA, 64 nt, hsa
guauauauuuauauauuuauauauauauuucauauauauauauaauauugcaagcuuaaguuug

SEQ ID NO: 755085 - RNA, 64 nt, hsa
auauauuuauauauuuauauauauauuucauauauauauauaauauugcaagcuuaaguuugca

SEQ ID NO: 755086 - RNA, 64 nt, hsa
cuugguugauggccaugcaucuucagucagaauuuauauauaaauguaugcacccauuuuuuug

SEQ ID NO: 755087 - RNA, 64 nt, hsa
gcauaacauacugcuauuggucuuuuuauauaaauauauauauauauauacauauauauauaua

SEQ ID NO: 755088 - RNA, 64 nt, hsa
auaacauacugcuauuggucuuuuuauauaaauauauauauauauauacauauauauauauaau

SEQ ID NO: 755089 - RNA, 64 nt, hsa
aacauacugcuauuggucuuuuuauauaaauauauauauauauauacauauauauauauaauuu

SEQ ID NO: 755090 - RNA, 64 nt, hsa
cauacugcuauuggucuuuuuauauaaauauauauauauauauacauauauauauauaauuuga

SEQ ID NO: 755091 - RNA, 64 nt, hsa
uacugcuauuggucuuuuuauauaaauauauauauauauauacauauauauauauaauuugaau

SEQ ID NO: 755092 - RNA, 64 nt, hsa
ggucuuuuuauauaaauauauauauauauauacauauauauauauaauuugaauuuuuggaaac

SEQ ID NO: 755093 - RNA, 64 nt, hsa
ucuuuuuauauaaauauauauauauauauacauauauauauauaauuugaauuuuuggaaacuu

SEQ ID NO: 755094 - RNA, 64 nt, hsa
uuuuuauauaaauauauauauauauauacauauauauauauaauuugaauuuuuggaaacuuua

SEQ ID NO: 755095 - RNA, 64 nt, hsa
acaagcaugagugugauuguaugugcacuguguguauauauauaaauauauguauauguauggu

SEQ ID NO: 755096 - RNA, 64 nt, hsa
aagcaugagugugauuguaugugcacuguguguauauauauaaauauauguauauguaugguug

SEQ ID NO: 755097 - RNA, 64 nt, hsa
uguagagucuagauuuauauacugcaauguaaaauauauauauauuuaccuuuuuuaaagacaa

SEQ ID NO: 755098 - RNA, 64 nt, hsa
uagagucuagauuuauauacugcaauguaaaauauauauauauuuaccuuuuuuaaagacaaug

SEQ ID NO: 755099 - RNA, 64 nt, hsa
uauuuuauuuuugagaaggaaaaaaaaagucauguauauauacacauaaaggcauauagcuaua

SEQ ID NO: 755100 - RNA, 64 nt, hsa
aagucauguauauauacacauaaaggcauauagcuauauauaaagagauaaggguguuuaugaa

SEQ ID NO: 755101 - RNA, 64 nt, hsa
aaauuagcaguuucauaagauucaaccaaauaaauauauauauacacacacacauacauauaca

SEQ ID NO: 755102 - RNA, 64 nt, hsa
auuagcaguuucauaagauucaaccaaauaaauauauauauacacacacacauacauauacacc

SEQ ID NO: 755103 - RNA, 64 nt, hsa
augcugguuuuguguuuuauccaacuuuugugcauauauauaaaguaugucauggcaugguuug

SEQ ID NO: 755104 - RNA, 64 nt, hsa
agaaguauuuccuguaacuauagaaagaauuauguauauauacaugcagaaauauauaugugug

SEQ ID NO: 755105 - RNA, 64 nt, hsa
uguaucuguggauggauauauguauaucucuuccuauauauauccauaguggacuuauucagaa

SEQ ID NO: 755106 - RNA, 53 nt, hsa
cucaagaacuuuggaaauaauuuuauauauauauaaauaauauauauauauau

SEQ ID NO: 755107 - RNA, 55 nt, hsa
cucaagaacuuuggaaauaauuuuauauauauauaaauaauauauauauauauac

SEQ ID NO: 755108 - RNA, 57 nt, hsa
cucaagaacuuuggaaauaauuuuauauauauauaaauaauauauauauauauacau

SEQ ID NO: 755109 - RNA, 64 nt, hsa
aacuuuggaaauaauuuuauauauauauaaauaauauauauauauauacauauauauaaauaga

SEQ ID NO: 755110 - RNA, 64 nt, hsa
cuuuggaaauaauuuuauauauauauaaauaauauauauauauauacauauauauaaauagauc

SEQ ID NO: 755111 - RNA, 64 nt, hsa
uuggaaauaauuuuauauauauauaaauaauauauauauauauacauauauauaaauagaucuc

SEQ ID NO: 755112 - RNA, 64 nt, hsa
ggaaauaauuuuauauauauauaaauaauauauauauauauacauauauauaaauagaucucua

SEQ ID NO: 755113 - RNA, 64 nt, hsa
uuauauauauauaaauaauauauauauauauacauauauauaaauagaucucuauauaguugug

SEQ ID NO: 755114 - RNA, 64 nt, hsa
cuauuuaacugcuaaagaaccuuuuauauauauauauauauaaauagagagaucuauacaggua

SEQ ID NO: 755115 - RNA, 64 nt, hsa
aucuauuuaacugcuaaagaaccuuuuauauauauauauauauaaauagagagaucuauacagg

SEQ ID NO: 755116 - RNA, 64 nt, hsa
gaaucuauuuaacugcuaaagaaccuuuuauauauauauauauauaaauagagagaucuauaca

SEQ ID NO: 755117 - RNA, 64 nt, hsa
uggaaucuauuuaacugcuaaagaaccuuuuauauauauauauauauaaauagagagaucuaua

SEQ ID NO: 755118 - RNA, 64 nt, hsa
auuggaaucuauuuaacugcuaaagaaccuuuuauauauauauauauauaaauagagagaucua

SEQ ID NO: 755119 - RNA, 64 nt, hsa
auauuggaaucuauuuaacugcuaaagaaccuuuuauauauauauauauauaaauagagagauc

SEQ ID NO: 755120 - RNA, 64 nt, hsa
ucucaccaaucaacacuuuuaagaaauauauauauauauauacacacauauacacaugccuucu

SEQ ID NO: 755121 - RNA, 64 nt, hsa
uuucucaccaaucaacacuuuuaagaaauauauauauauauauacacacauauacacaugccuu

SEQ ID NO: 755122 - RNA, 64 nt, hsa
cuuuucucaccaaucaacacuuuuaagaaauauauauauauauauacacacauauacacaugcc

SEQ ID NO: 755123 - RNA, 64 nt, hsa
uucuuuucucaccaaucaacacuuuuaagaaauauauauauauauauacacacauauacacaug

SEQ ID NO: 755124 - RNA, 64 nt, hsa
uauucuuuucucaccaaucaacacuuuuaagaaauauauauauauauauacacacauauacaca

SEQ ID NO: 755125 - RNA, 64 nt, hsa
guuuagugcuguaauugucuuauuauuuuuuuuauauauauauuucuuggaguaaacauuuuaa

SEQ ID NO: 755126 - RNA, 64 nt, hsa
ugguuuagugcuguaauugucuuauuauuuuuuuuauauauauauuucuuggaguaaacauuuu

SEQ ID NO: 755127 - RNA, 64 nt, hsa
cacuguuuauaaaaaauauauauauauauauauauauauauaaugaaaaagguuucagaguugc

SEQ ID NO: 755128 - RNA, 64 nt, hsa
aacacuguuuauaaaaaauauauauauauauauauauauauauaaugaaaaagguuucagaguu

SEQ ID NO: 755129 - RNA, 64 nt, hsa
uuaacacuguuuauaaaaaauauauauauauauauauauauauauaaugaaaaagguuucagag

SEQ ID NO: 755130 - RNA, 64 nt, hsa
auuuaacacuguuuauaaaaaauauauauauauauauauauauauauaaugaaaaagguuucag

SEQ ID NO: 755131 - RNA, 64 nt, hsa
gcauuuaacacuguuuauaaaaaauauauauauauauauauauauauauaaugaaaaagguuuc

SEQ ID NO: 755132 - RNA, 64 nt, hsa
uggcauuuaacacuguuuauaaaaaauauauauauauauauauauauauauaaugaaaaagguu

SEQ ID NO: 755133 - RNA, 64 nt, hsa
acuggcauuuaacacuguuuauaaaaaauauauauauauauauauauauauauaaugaaaaagg

SEQ ID NO: 755134 - RNA, 64 nt, hsa
aaacuggcauuuaacacuguuuauaaaaaauauauauauauauauauauauauauaaugaaaaa

SEQ ID NO: 755135 - RNA, 64 nt, hsa
ccaaacuggcauuuaacacuguuuauaaaaaauauauauauauauauauauauauauaaugaaa

SEQ ID NO: 755136 - RNA, 64 nt, hsa
ccccaaacuggcauuuaacacuguuuauaaaaaauauauauauauauauauauauauauaauga

SEQ ID NO: 755137 - RNA, 64 nt, hsa
caagagaaaagacuguuaacuggaagaaaaaauauauauauaaaauuuuauguagacacguuua

SEQ ID NO: 755138 - RNA, 64 nt, hsa
cccaagagaaaagacuguuaacuggaagaaaaaauauauauauaaaauuuuauguagacacguu

SEQ ID NO: 755139 - RNA, 64 nt, hsa
aaaaaucuuuuuucacuucucaugauagcuguuauauauauaugcuaaaucuuuauauacagaa

SEQ ID NO: 755140 - RNA, 64 nt, hsa
ggaaaaaucuuuuuucacuucucaugauagcuguuauauauauaugcuaaaucuuuauauacag

SEQ ID NO: 755141 - RNA, 64 nt, hsa
uauaguauauaagagagagggguguuuguguguauauauauaugccuuuguguauacacuuauc

SEQ ID NO: 755142 - RNA, 64 nt, hsa
uguauaguauauaagagagagggguguuuguguguauauauauaugccuuuguguauacacuua

SEQ ID NO: 755143 - RNA, 64 nt, hsa
uauccccaauugcuucagucauucauuuguucaguauauauauuuugaauucuaguuuucauaa

SEQ ID NO: 755144 - RNA, 64 nt, hsa
cuuuuauauauucuuuuuccacuuuugaucuauuuauauauauguauguguuuuuaaaauaugu

SEQ ID NO: 755145 - RNA, 64 nt, hsa
aauuuaaaugaauuugauuuaaauguuuccugaauauauauacagauagauagaugaguaucaa

SEQ ID NO: 755146 - RNA, 64 nt, hsa
uauauauauauauauauauauauauauauauauauauauauauuuuacagucuuaucugccuuu

SEQ ID NO: 755147 - RNA, 64 nt, hsa
gaaauaauuuguuucauauguauauauauauauauauauauauauuuuacagucuuaucugccu

SEQ ID NO: 755148 - RNA, 64 nt, hsa
uggaaauaauuuguuucauauguauauauauauauauauauauauauuuuacagucuuaucugc

SEQ ID NO: 755149 - RNA, 64 nt, hsa
uuuggaaauaauuuguuucauauguauauauauauauauauauauauauuuuacagucuuaucu

SEQ ID NO: 755150 - RNA, 64 nt, hsa
uuuuuggaaauaauuuguuucauauguauauauauauauauauauauauauuuuacagucuuau

SEQ ID NO: 755151 - RNA, 64 nt, hsa
gcuuuuuggaaauaauuuguuucauauguauauauauauauauauauauauauuuuacagucuu

SEQ ID NO: 755152 - RNA, 64 nt, hsa
gggcuuuuuggaaauaauuuguuucauauguauauauauauauauauauauauauuuuacaguc

SEQ ID NO: 755153 - RNA, 64 nt, hsa
uagggcuuuuuggaaauaauuuguuucauauguauauauauauauauauauauauauuuuacag

SEQ ID NO: 755154 - RNA, 64 nt, hsa
auuagggcuuuuuggaaauaauuuguuucauauguauauauauauauauauauauauauuuuac

SEQ ID NO: 755155 - RNA, 64 nt, hsa
guaugacuguguuauacuugauaauauauauauauauauauaucaacuuguuaaauuauuucau

SEQ ID NO: 755156 - RNA, 64 nt, hsa
uuguaugacuguguuauacuugauaauauauauauauauauauaucaacuuguuaaauuauuuc

SEQ ID NO: 755157 - RNA, 64 nt, hsa
uuuuguaugacuguguuauacuugauaauauauauauauauauauaucaacuuguuaaauuauu

SEQ ID NO: 755158 - RNA, 64 nt, hsa
guuuuuguaugacuguguuauacuugauaauauauauauauauauauaucaacuuguuaaauua

SEQ ID NO: 755159 - RNA, 64 nt, hsa
auguuuuuguaugacuguguuauacuugauaauauauauauauauauauaucaacuuguuaaau

SEQ ID NO: 755160 - RNA, 64 nt, hsa
aaauguuuuuguaugacuguguuauacuugauaauauauauauauauauauaucaacuuguuaa

SEQ ID NO: 755161 - RNA, 64 nt, hsa
gcucucuuuuuuaaaauauagguaucucuuugcauauauauacacaaggaaaguugaauuuuca

SEQ ID NO: 755162 - RNA, 64 nt, hsa
cuauggaaggggcuuuguuguaaauacuauguaauauauauaaaauauugugacauguuuugga

SEQ ID NO: 755163 - RNA, 64 nt, hsa
uacauguauguauauacagauguguguguauauauauauauacauacacauauacauaaauuuu

SEQ ID NO: 755164 - RNA, 64 nt, hsa
uauacauguauguauauacagauguguguguauauauauauauacauacacauauacauaaauu

SEQ ID NO: 755165 - RNA, 64 nt, hsa
uauauacauguauguauauacagauguguguguauauauauauauacauacacauauacauaaa

SEQ ID NO: 755166 - RNA, 64 nt, hsa
aauauauacauguauguauauacagauguguguguauauauauauauacauacacauauacaua

SEQ ID NO: 755167 - RNA, 64 nt, hsa
auauauauauauaucuguauagacacacauauaauauauauagauauauaaucccuauauaucu

SEQ ID NO: 755168 - RNA, 64 nt, hsa
uauacacacacacacagaaagaugaauauauauauauauauaucuguauagacacacauauaau

SEQ ID NO: 755169 - RNA, 64 nt, hsa
uauauacacacacacacagaaagaugaauauauauauauauauaucuguauagacacacauaua

SEQ ID NO: 755170 - RNA, 64 nt, hsa
uauauauacacacacacacagaaagaugaauauauauauauauauaucuguauagacacacaua

SEQ ID NO: 755171 - RNA, 64 nt, hsa
gauauauauacacacacacacagaaagaugaauauauauauauauauaucuguauagacacaca

SEQ ID NO: 755172 - RNA, 64 nt, hsa
uggauauauauacacacacacacagaaagaugaauauauauauauauauaucuguauagacaca

SEQ ID NO: 755173 - RNA, 64 nt, hsa
cuaagcaacaauagauuuuauauguguguguggauauauauacacacacacacagaaagaugaa

SEQ ID NO: 755174 - RNA, 64 nt, hsa
ggcaacagaaacaaguuaaggaaacaaaaauacuuauauauacacagaacaaaaauaauguucu

SEQ ID NO: 755175 - RNA, 64 nt, hsa
acauagauaugucauguuauuauauauauaaauauauauauaauuuuguacguuuucuucaucu

SEQ ID NO: 755176 - RNA, 64 nt, hsa
guacauagauaugucauguuauuauauauauaaauauauauauaauuuuguacguuuucuucau

SEQ ID NO: 755177 - RNA, 64 nt, hsa
cagccauguuguacauagauaugucauguuauuauauauauaaauauauauauaauuuuguacg

SEQ ID NO: 755178 - RNA, 64 nt, hsa
cccagccauguuguacauagauaugucauguuauuauauauauaaauauauauauaauuuugua

SEQ ID NO: 755179 - RNA, 64 nt, hsa
aacugggucugggauuauuuuaaaauuauauauauauauauaaagauauauucuuacaucuuuu

SEQ ID NO: 755180 - RNA, 64 nt, hsa
ggaacugggucugggauuauuuuaaaauuauauauauauauauaaagauauauucuuacaucuu

SEQ ID NO: 755181 - RNA, 64 nt, hsa
auggaacugggucugggauuauuuuaaaauuauauauauauauauaaagauauauucuuacauc

SEQ ID NO: 755182 - RNA, 64 nt, hsa
uaauggaacugggucugggauuauuuuaaaauuauauauauauauauaaagauauauucuuaca

SEQ ID NO: 755183 - RNA, 64 nt, hsa
guuaauggaacugggucugggauuauuuuaaaauuauauauauauauauaaagauauauucuua

SEQ ID NO: 755184 - RNA, 64 nt, hsa
uagguguauauauacauauauauauauauaaauauauauauaauauauaaaauauagauaugga

SEQ ID NO: 755185 - RNA, 64 nt, hsa
gcuagguguauauauacauauauauauauauaaauauauauauaauauauaaaauauagauaug

SEQ ID NO: 755186 - RNA, 64 nt, hsa
uacacacugugcuagguguauauauacauauauauauauauaaauauauauauaauauauaaaa

SEQ ID NO: 755187 - RNA, 64 nt, hsa
uauacacacugugcuagguguauauauacauauauauauauauaaauauauauauaauauauaa

SEQ ID NO: 755188 - RNA, 64 nt, hsa
aauauacacacugugcuagguguauauauacauauauauauauauaaauauauauauaauauau

SEQ ID NO: 755189 - RNA, 64 nt, hsa
agaauauacacacugugcuagguguauauauacauauauauauauauaaauauauauauaauau

SEQ ID NO: 755190 - RNA, 64 nt, hsa
ccugaugaauagaauauacacacugugcuagguguauauauacauauauauauauauaaauaua

SEQ ID NO: 755191 - RNA, 64 nt, hsa
agguuuaucuaagaagaaagaaacagagauaauauauauauagaaagauguauauagauguaua

SEQ ID NO: 755192 - RNA, 64 nt, hsa
aaagguuuaucuaagaagaaagaaacagagauaauauauauauagaaagauguauauagaugua

SEQ ID NO: 755193 - RNA, 64 nt, hsa
agaaaaguuuagacuuauaaaaaggcagauaguauauauauauuuauauacauguauguauaug

SEQ ID NO: 755194 - RNA, 64 nt, hsa
guagaaaaguuuagacuuauaaaaaggcagauaguauauauauauuuauauacauguauguaua

SEQ ID NO: 755195 - RNA, 64 nt, hsa
ucuguuauuguccuguguguacaguauauauauguauauauauuuuaauuuuuuaauuuaagca

SEQ ID NO: 755196 - RNA, 64 nt, hsa
uucaacacucucuguuauuguccuguguguacaguauauauauguauauauauuuuaauuuuuu

SEQ ID NO: 755197 - RNA, 64 nt, hsa
aaaauaugauauacacacacauuauauauauauauauauauacacacacacacacacacacacg

SEQ ID NO: 755198 - RNA, 64 nt, hsa
aaaaaauaugauauacacacacauuauauauauauauauauauacacacacacacacacacaca

SEQ ID NO: 755199 - RNA, 64 nt, hsa
agaaaaaauaugauauacacacacauuauauauauauauauauauacacacacacacacacaca

SEQ ID NO: 755200 - RNA, 64 nt, hsa
uaagaaaaaauaugauauacacacacauuauauauauauauauauauacacacacacacacaca

SEQ ID NO: 755201 - RNA, 64 nt, hsa
acuaagaaaaaauaugauauacacacacauuauauauauauauauauauacacacacacacaca

SEQ ID NO: 755202 - RNA, 64 nt, hsa
aaacuaagaaaaaauaugauauacacacacauuauauauauauauauauauacacacacacaca

SEQ ID NO: 755203 - RNA, 64 nt, hsa
uaaaacuaagaaaaaauaugauauacacacacauuauauauauauauauauauacacacacaca

SEQ ID NO: 755204 - RNA, 64 nt, hsa
uaccuagcuacaacuuuuaugucucuuguaaauuuauauauacuuucagugccauugugaagaa

SEQ ID NO: 755205 - RNA, 64 nt, hsa
uaacuucguuugugcgauugaaauaaaauugcaguauauauauguugcuuguuugugacacuua

SEQ ID NO: 755206 - RNA, 64 nt, hsa
aaaacugcuugaauuguauauauaucuccauauauauauauauccaagacaagggaaauguaga

SEQ ID NO: 755207 - RNA, 64 nt, hsa
uuaaaacugcuugaauuguauauauaucuccauauauauauauauccaagacaagggaaaugua

SEQ ID NO: 755208 - RNA, 64 nt, hsa
aauuaaaacugcuugaauuguauauauaucuccauauauauauauauccaagacaagggaaaug

SEQ ID NO: 755209 - RNA, 64 nt, hsa
caaugauuacccuuaauuaaaacugcuugaauuguauauauaucuccauauauauauauaucca

SEQ ID NO: 755210 - RNA, 64 nt, hsa
agaaggacugaacaacuguugggauauauauauauauauauaauuuuuuuuuuuuaaauuccug

SEQ ID NO: 755211 - RNA, 64 nt, hsa
guagaaggacugaacaacuguugggauauauauauauauauauaauuuuuuuuuuuuaaauucc

SEQ ID NO: 755212 - RNA, 64 nt, hsa
ugguagaaggacugaacaacuguugggauauauauauauauauauaauuuuuuuuuuuuaaauu

SEQ ID NO: 755213 - RNA, 64 nt, hsa
uuugguagaaggacugaacaacuguugggauauauauauauauauauaauuuuuuuuuuuuaaa

SEQ ID NO: 755214 - RNA, 64 nt, hsa
cauuugguagaaggacugaacaacuguugggauauauauauauauauauaauuuuuuuuuuuua

SEQ ID NO: 755215 - RNA, 64 nt, hsa
agcauuugguagaaggacugaacaacuguugggauauauauauauauauauaauuuuuuuuuuu

SEQ ID NO: 755216 - RNA, 64 nt, hsa
aaaaccauguggcaguuccuguuuuugauuuuauuauauauauguauauaauaugaaaguaguc

SEQ ID NO: 755217 - RNA, 64 nt, hsa
cauaguuuuguucaauugcguuguugguuuuugcuauauauacacauguugacugucaucuugu

SEQ ID NO: 755218 - RNA, 64 nt, hsa
cucagauucucauuuauuagugagcacaccuguguauauauauaaaucacaaggagaucaucaa

SEQ ID NO: 755219 - RNA, 64 nt, hsa
cagauucucauuuauuagugagcacaccuguguauauauauaaaucacaaggagaucaucaagg

SEQ ID NO: 755220 - RNA, 64 nt, hsa
uuuugaacuaagaaacuuuuguaaagaaauuuacuauauauauaugccuuuuuccuagccuguu

SEQ ID NO: 755221 - RNA, 64 nt, hsa
uugaacuaagaaacuuuuguaaagaaauuuacuauauauauaugccuuuuuccuagccuguuuc

SEQ ID NO: 755222 - RNA, 64 nt, hsa
aaaaacaaaaguauuugugugcauguguauauaauauauauauauacauauauauuuauacaca

SEQ ID NO: 755223 - RNA, 64 nt, hsa
aaacaaaaguauuugugugcauguguauauaauauauauauauacauauauauuuauacacaua

SEQ ID NO: 755224 - RNA, 64 nt, hsa
acaaaaguauuugugugcauguguauauaauauauauauauacauauauauuuauacacauaca

SEQ ID NO: 755225 - RNA, 64 nt, hsa
uaacuuggauuccuuuguauauaguaaaguuuaguauauauauauuuuuuucuuuuugcuacuu

SEQ ID NO: 755226 - RNA, 64 nt, hsa
acuuggauuccuuuguauauaguaaaguuuaguauauauauauuuuuuucuuuuugcuacuuuc

SEQ ID NO: 755227 - RNA, 64 nt, hsa
ccaggaaacagaacuuuaagauauauacagcacauauauauauauauacauauauauauacaca

SEQ ID NO: 755228 - RNA, 64 nt, hsa
aggaaacagaacuuuaagauauauacagcacauauauauauauauacauauauauauacacaua

SEQ ID NO: 755229 - RNA, 64 nt, hsa
gaaacagaacuuuaagauauauacagcacauauauauauauauacauauauauauacacauaua

SEQ ID NO: 755230 - RNA, 64 nt, hsa
aacagaacuuuaagauauauacagcacauauauauauauauacauauauauauacacauauaua

SEQ ID NO: 755231 - RNA, 64 nt, hsa
uaagauauauacagcacauauauauauauauacauauauauauacacauauauaaaaaacaaaa

SEQ ID NO: 755232 - RNA, 64 nt, hsa
agauauauacagcacauauauauauauauacauauauauauacacauauauaaaaaacaaaagc

SEQ ID NO: 755233 - RNA, 64 nt, hsa
uucaggcuucaguaaaucuuuuuuucuuccuucauauauauauacacaacacacacacacauau

SEQ ID NO: 755234 - RNA, 64 nt, hsa
caggcuucaguaaaucuuuuuuucuuccuucauauauauauacacaacacacacacacauaugu

SEQ ID NO: 755235 - RNA, 64 nt, hsa
acacacacacgugcacacacacacacacacacacuauauauauauauauuauuuacagggaaau

SEQ ID NO: 755236 - RNA, 64 nt, hsa
acacacacgugcacacacacacacacacacacuauauauauauauauuauuuacagggaaauuu

SEQ ID NO: 755237 - RNA, 64 nt, hsa
acacacgugcacacacacacacacacacacuauauauauauauauuauuuacagggaaauuuuu

SEQ ID NO: 755238 - RNA, 64 nt, hsa
acacgugcacacacacacacacacacacuauauauauauauauuauuuacagggaaauuuuuca

SEQ ID NO: 755239 - RNA, 64 nt, hsa
ccccuugauuggcguguguguauauauggauaaauauauauauacacacacacauauuacugca

SEQ ID NO: 755240 - RNA, 64 nt, hsa
ccuugauuggcguguguguauauauggauaaauauauauauacacacacacauauuacugcaau

SEQ ID NO: 755241 - RNA, 64 nt, hsa
gcauuaaauuguuuugguucuaaauuuggaacaguauauauaauuaaaaguaaggaacauuaga

SEQ ID NO: 755242 - RNA, 64 nt, hsa
cuagcuagguauuccugggauuauuauacugagauauauauauauacacacacacacacauaug

SEQ ID NO: 755243 - RNA, 64 nt, hsa
agcuagguauuccugggauuauuauacugagauauauauauauacacacacacacacauaugug

SEQ ID NO: 755244 - RNA, 64 nt, hsa
cuagguauuccugggauuauuauacugagauauauauauauacacacacacacacauaugugua

SEQ ID NO: 755245 - RNA, 64 nt, hsa
uauauacacacacacacacauauguguauauauguauauauauaugugaguauauauacacaca

SEQ ID NO: 755246 - RNA, 64 nt, hsa
uauacacacacacacacauauguguauauauguauauauauaugugaguauauauacacacaca

SEQ ID NO: 755247 - RNA, 64 nt, hsa
cacauauguguauauauguauauauauaugugaguauauauacacacacacacacacacacaca

SEQ ID NO: 755248 - RNA, 64 nt, hsa
ugaguauauauacacacacacacacacacacacauauauauauauacacacacgcacacauaua

SEQ ID NO: 755249 - RNA, 64 nt, hsa
aguauauauacacacacacacacacacacacauauauauauauacacacacgcacacauauaug

SEQ ID NO: 755250 - RNA, 64 nt, hsa
uauauauacacacacacacacacacacacauauauauauauacacacacgcacacauauauguu

SEQ ID NO: 755251 - RNA, 64 nt, hsa
uggcauauuuauauuguauauucuggaaaaaaaauauauauauauauuuaaaggggagauacuc

SEQ ID NO: 755252 - RNA, 64 nt, hsa
gcauauuuauauuguauauucuggaaaaaaaauauauauauauauuuaaaggggagauacucuc

SEQ ID NO: 755253 - RNA, 64 nt, hsa
auauuuauauuguauauucuggaaaaaaaauauauauauauauuuaaaggggagauacucuccc

SEQ ID NO: 755254 - RNA, 64 nt, hsa
uguguguguguguguauguauacacacauauacauauauauauacacauacauacacauacaua

SEQ ID NO: 755255 - RNA, 64 nt, hsa
uguguguguguguauguauacacacauauacauauauauauacacauacauacacauacauaca

SEQ ID NO: 755256 - RNA, 64 nt, hsa
cuuuugugggggaaugccuaauaaauacauugacuauauauaaaaugaauauauacauacacau

SEQ ID NO: 755257 - RNA, 64 nt, hsa
auaaaaugaauauauacauacacauguaugccuguauauauauauucauucuccaguguugcug

SEQ ID NO: 755258 - RNA, 64 nt, hsa
aaaaugaauauauacauacacauguaugccuguauauauauauucauucuccaguguugcugaa

SEQ ID NO: 755259 - RNA, 64 nt, hsa
guucgugcugcaagugaucuguaaucccuaugaguauauauauauauauauauauauauauaua

SEQ ID NO: 755260 - RNA, 64 nt, hsa
ucgugcugcaagugaucuguaaucccuaugaguauauauauauauauauauauauauauauaaa

SEQ ID NO: 755261 - RNA, 64 nt, hsa
gugcugcaagugaucuguaaucccuaugaguauauauauauauauauauauauauauauaaaaa

SEQ ID NO: 755262 - RNA, 64 nt, hsa
gcugcaagugaucuguaaucccuaugaguauauauauauauauauauauauauauauaaaaacu

SEQ ID NO: 755263 - RNA, 64 nt, hsa
ugcaagugaucuguaaucccuaugaguauauauauauauauauauauauauauauaaaaacuua

SEQ ID NO: 755264 - RNA, 64 nt, hsa
caagugaucuguaaucccuaugaguauauauauauauauauauauauauauauaaaaacuuagc

SEQ ID NO: 755265 - RNA, 64 nt, hsa
agugaucuguaaucccuaugaguauauauauauauauauauauauauauauaaaaacuuagcac

SEQ ID NO: 755266 - RNA, 64 nt, hsa
ugaucuguaaucccuaugaguauauauauauauauauauauauauauauaaaaacuuagcacgu

SEQ ID NO: 755267 - RNA, 64 nt, hsa
aucuguaaucccuaugaguauauauauauauauauauauauauauauaaaaacuuagcacgugu

SEQ ID NO: 755268 - RNA, 64 nt, hsa
cuguaaucccuaugaguauauauauauauauauauauauauauauaaaaacuuagcacguguaa

SEQ ID NO: 755269 - RNA, 64 nt, hsa
guaaucccuaugaguauauauauauauauauauauauauauauaaaaacuuagcacguguaauu

SEQ ID NO: 755270 - RNA, 64 nt, hsa
aaucccuaugaguauauauauauauauauauauauauauauaaaaacuuagcacguguaauuua

SEQ ID NO: 755271 - RNA, 64 nt, hsa
guuugaaauaucacacaaaggcugauuucuaaaauauauauauauuaaaacaauaaaguauuua

SEQ ID NO: 755272 - RNA, 64 nt, hsa
uugaaauaucacacaaaggcugauuucuaaaauauauauauauuaaaacaauaaaguauuuauu

SEQ ID NO: 755273 - RNA, 64 nt, hsa
ccagugaugcuaaagguuguauugcauauauacauauauauauauauauauauauauauauaua

SEQ ID NO: 755274 - RNA, 64 nt, hsa
agugaugcuaaagguuguauugcauauauacauauauauauauauauauauauauauauauaua

SEQ ID NO: 755275 - RNA, 64 nt, hsa
ugaugcuaaagguuguauugcauauauacauauauauauauauauauauauauauauauauaua

SEQ ID NO: 755276 - RNA, 64 nt, hsa
augcuaaagguuguauugcauauauacauauauauauauauauauauauauauauauauauaua

SEQ ID NO: 755277 - RNA, 64 nt, hsa
gcuaaagguuguauugcauauauacauauauauauauauauauauauauauauauauauauaua

SEQ ID NO: 755278 - RNA, 64 nt, hsa
uaaagguuguauugcauauauacauauauauauauauauauauauauauauauauauauauaua

SEQ ID NO: 755279 - RNA, 64 nt, hsa
aagguuguauugcauauauacauauauauauauauauauauauauauauauauauauauauaua

SEQ ID NO: 755280 - RNA, 64 nt, hsa
ugcauauauacauauauauauauauauauauauauauauauauauauauauauauauauauaua

SEQ ID NO: 755281 - RNA, 64 nt, hsa
cauauauacauauauauauauauauauauauauauauauauauauauauauauauauauauaua

SEQ ID NO: 755282 - RNA, 64 nt, hsa
uauauacauauauauauauauauauauauauauauauauauauauauauauauauauauauauu

SEQ ID NO: 755283 - RNA, 64 nt, hsa
uauacauauauauauauauauauauauauauauauauauauauauauauauauauauauauuuu

SEQ ID NO: 755284 - RNA, 64 nt, hsa
uacauauauauauauauauauauauauauauauauauauauauauauauauauauauauuuuaa

SEQ ID NO: 755285 - RNA, 64 nt, hsa
cauauauauauauauauauauauauauauauauauauauauauauauauauauauauuuuaauu

SEQ ID NO: 755286 - RNA, 64 nt, hsa
uauauauauauauauauauauauauauauauauauauauauauauauauauauauuuuaauuug

SEQ ID NO: 755287 - RNA, 64 nt, hsa
uauauauauauauauauauauauauauauauauauauauauauauauauauauuuuaauuugau

SEQ ID NO: 755288 - RNA, 64 nt, hsa
uauauauauauauauauauauauauauauauauauauauauauauauauauuuuaauuugauag

SEQ ID NO: 755289 - RNA, 64 nt, hsa
uauauauauauauauauauauauauauauauauauauauauauauauauuuuaauuugauagua

SEQ ID NO: 755290 - RNA, 64 nt, hsa
uauauauauauauauauauauauauauauauauauauauauauauauuuuaauuugauaguauu

SEQ ID NO: 755291 - RNA, 64 nt, hsa
uauauauauauauauauauauauauauauauauauauauauauauuuuaauuugauaguauugu

SEQ ID NO: 755292 - RNA, 64 nt, hsa
uauauauauauauauauauauauauauauauauauauauauauuuuaauuugauaguauugugc

SEQ ID NO: 755293 - RNA, 64 nt, hsa
uuccaucuguuugauacaguauuauagauauaaauauauauauauuucucuguggccauuugug

SEQ ID NO: 755294 - RNA, 64 nt, hsa
ccaucuguuugauacaguauuauagauauaaauauauauauauuucucuguggccauuugugau

SEQ ID NO: 755295 - RNA, 64 nt, hsa
uaaggaugacacuaauuguuagcuguuuugaaauuauauauauauaaauauauauaaauauaua

SEQ ID NO: 755296 - RNA, 64 nt, hsa
aggaugacacuaauuguuagcuguuuugaaauuauauauauauaaauauauauaaauauauaaa

SEQ ID NO: 755297 - RNA, 64 nt, hsa
gaugacacuaauuguuagcuguuuugaaauuauauauauauaaauauauauaaauauauaaaua

SEQ ID NO: 755298 - RNA, 64 nt, hsa
auuguuagcuguuuugaaauuauauauauauaaauauauauaaauauauaaauauaugccaguc

SEQ ID NO: 755299 - RNA, 64 nt, hsa
gacgaauauucugauacaauacucaaccucgguauauauauauguguauaaauauauguauauc

SEQ ID NO: 755300 - RNA, 64 nt, hsa
acgacgaauauucugauacaauacucaaccucgguauauauauauguguauaaauauauguaua

SEQ ID NO: 755301 - RNA, 64 nt, hsa
uuggaaacauguaacaaagcaaggguaaaauauauauauauaucuauauaagugcugugacugu

SEQ ID NO: 755302 - RNA, 64 nt, hsa
auuuggaaacauguaacaaagcaaggguaaaauauauauauauaucuauauaagugcugugacu

SEQ ID NO: 755303 - RNA, 64 nt, hsa
aaauuuggaaacauguaacaaagcaaggguaaaauauauauauauaucuauauaagugcuguga

SEQ ID NO: 755304 - RNA, 64 nt, hsa
uauauauauauaaacacacacacauauauauauauauauauaguacucuaauacugcaagaagg

SEQ ID NO: 755305 - RNA, 64 nt, hsa
uguauauauauauaaacacacacacauauauauauauauauauaguacucuaauacugcaagaa

SEQ ID NO: 755306 - RNA, 64 nt, hsa
uguguauauauauauaaacacacacacauauauauauauauauauaguacucuaauacugcaag

SEQ ID NO: 755307 - RNA, 64 nt, hsa
acuguguauauauauauaaacacacacacauauauauauauauauauaguacucuaauacugca

SEQ ID NO: 755308 - RNA, 64 nt, hsa
auacuguguauauauauauaaacacacacacauauauauauauauauauaguacucuaauacug

SEQ ID NO: 755309 - RNA, 64 nt, hsa
uuauacuguguauauauauauaaacacacacacauauauauauauauauauaguacucuaauac

SEQ ID NO: 755310 - RNA, 64 nt, hsa
gcaucuuuaagaagugaccauuauacuguguauauauauauaaacacacacacauauauauaua

SEQ ID NO: 755311 - RNA, 64 nt, hsa
cugcaucuuuaagaagugaccauuauacuguguauauauauauaaacacacacacauauauaua

SEQ ID NO: 755312 - RNA, 64 nt, hsa
gacugcaucuuuaagaagugaccauuauacuguguauauauauauaaacacacacacauauaua

SEQ ID NO: 755313 - RNA, 64 nt, hsa
uuacaguuuauauauauaugauagauaugagauauauauauaaaagguacuguuaacuacugua

SEQ ID NO: 755314 - RNA, 64 nt, hsa
guuuacaguuuauauauauaugauagauaugagauauauauauaaaagguacuguuaacuacug

SEQ ID NO: 755315 - RNA, 64 nt, hsa
cuagaagccgcuguuaccucuuguuuacaguuuauauauauaugauagauaugagauauauaua

SEQ ID NO: 755316 - RNA, 64 nt, hsa
uucuagaagccgcuguuaccucuuguuuacaguuuauauauauaugauagauaugagauauaua

SEQ ID NO: 755317 - RNA, 64 nt, hsa
uaugacuauacgggacauauguaauauauaaauauauauauaaaacauuccccucuguccccuu

SEQ ID NO: 755318 - RNA, 64 nt, hsa
cauaugacuauacgggacauauguaauauauaaauauauauauaaaacauuccccucugucccc

SEQ ID NO: 755319 - RNA, 64 nt, hsa
acuuaauuugucuucccauuucucuuuauauauauauauauaaauauaaauauauguuuguuug

SEQ ID NO: 755320 - RNA, 64 nt, hsa
ucacuuaauuugucuucccauuucucuuuauauauauauauauaaauauaaauauauguuuguu

SEQ ID NO: 755321 - RNA, 64 nt, hsa
gcucacuuaauuugucuucccauuucucuuuauauauauauauauaaauauaaauauauguuug

SEQ ID NO: 755322 - RNA, 64 nt, hsa
aggcucacuuaauuugucuucccauuucucuuuauauauauauauauaaauauaaauauauguu

SEQ ID NO: 755323 - RNA, 64 nt, hsa
auaggcucacuuaauuugucuucccauuucucuuuauauauauauauauaaauauaaauauaug

SEQ ID NO: 755324 - RNA, 64 nt, hsa
gaacuaucagauauaguaaauuuauauauauacauauauauacauaaaaauuauguauaaugga

SEQ ID NO: 755325 - RNA, 64 nt, hsa
gcuucuaaaggaacuaucagauauaguaaauuuauauauauacauauauauacauaaaaauuau

SEQ ID NO: 755326 - RNA, 64 nt, hsa
aggcuucuaaaggaacuaucagauauaguaaauuuauauauauacauauauauacauaaaaauu

SEQ ID NO: 755327 - RNA, 64 nt, hsa
aguuuuauugcaagagguaaagaagaaaacuauauauauauaucuuauuuagauaaucucagua

SEQ ID NO: 755328 - RNA, 64 nt, hsa
uaaguuuuauugcaagagguaaagaagaaaacuauauauauauaucuuauuuagauaaucucag

SEQ ID NO: 755329 - RNA, 64 nt, hsa
uauaaguuuuauugcaagagguaaagaagaaaacuauauauauauaucuuauuuagauaaucuc

SEQ ID NO: 755330 - RNA, 64 nt, hsa
cauaaaacauccuuacuuuuauuucacacaguuuuauauauagauagaagacuguacaauuuga

SEQ ID NO: 755331 - RNA, 64 nt, hsa
caagaaaguaucuauauauacauauguaaauauuuauauauagauauauguagcuuucuauaua

SEQ ID NO: 755332 - RNA, 64 nt, hsa
uauuuuucuucaucuuuuauaacaagaaaguaucuauauauacauauguaaauauuuauauaua

SEQ ID NO: 755333 - RNA, 64 nt, hsa
uuugccuaaggagguagcagcaaucccuaauauauauauauagugagaacuaaaauggauauau

SEQ ID NO: 755334 - RNA, 64 nt, hsa
cauuugccuaaggagguagcagcaaucccuaauauauauauauagugagaacuaaaauggauau

SEQ ID NO: 755335 - RNA, 64 nt, hsa
accauuugccuaaggagguagcagcaaucccuaauauauauauauagugagaacuaaaauggau

SEQ ID NO: 755336 - RNA, 64 nt, hsa
uuaauugucaauauuauuuuugucuaauucuguauauauauaacuuauuauauuuuauaaucuc

SEQ ID NO: 755337 - RNA, 64 nt, hsa
ucuuaauugucaauauuauuuuugucuaauucuguauauauauaacuuauuauauuuuauaauc

SEQ ID NO: 755338 - RNA, 64 nt, hsa
uuagggacuagaccaugugcuuuuuuaacacuuauauauauaauggucuauuugaagagcucac

SEQ ID NO: 755339 - RNA, 64 nt, hsa
uuuuagggacuagaccaugugcuuuuuuaacacuuauauauauaauggucuauuugaagagcuc

SEQ ID NO: 755340 - RNA, 64 nt, hsa
aagaaacuuuacuguagaguuacaaguacauuuauauauauauguugcugcaucacuuguguag

SEQ ID NO: 755341 - RNA, 64 nt, hsa
aaaagaaacuuuacuguagaguuacaaguacauuuauauauauauguugcugcaucacuugugu

SEQ ID NO: 755342 - RNA, 64 nt, hsa
ggccaagaggccucugguaaugaagugcuauauauauauauaugauggagucucacugugcugc

SEQ ID NO: 755343 - RNA, 64 nt, hsa
caggccaagaggccucugguaaugaagugcuauauauauauauaugauggagucucacugugcu

SEQ ID NO: 755344 - RNA, 64 nt, hsa
aacaggccaagaggccucugguaaugaagugcuauauauauauauaugauggagucucacugug

SEQ ID NO: 755345 - RNA, 64 nt, hsa
ucaacaggccaagaggccucugguaaugaagugcuauauauauauauaugauggagucucacug

SEQ ID NO: 755346 - RNA, 64 nt, hsa
uuguuuaucaaaugauuucuuuaaaucgauuauauauauauauggaauauuucaaaauucaaac

SEQ ID NO: 755347 - RNA, 64 nt, hsa
uuuuguuuaucaaaugauuucuuuaaaucgauuauauauauauauggaauauuucaaaauucaa

SEQ ID NO: 755348 - RNA, 64 nt, hsa
aguuuuguuuaucaaaugauuucuuuaaaucgauuauauauauauauggaauauuucaaaauuc

SEQ ID NO: 755349 - RNA, 64 nt, hsa
uuuguuuuuguuuuuugcuguuggcaguuuaaaauauauauaauuaauaaaaccugugcuugau

SEQ ID NO: 755350 - RNA, 64 nt, hsa
uuauuuuauccuguggugcauguuugggcaaauauauauauagccugauaaacaacuucuauua

SEQ ID NO: 755351 - RNA, 64 nt, hsa
aguuauuuuauccuguggugcauguuugggcaaauauauauauagccugauaaacaacuucuau

SEQ ID NO: 755352 - RNA, 64 nt, hsa
ugauguuuguguguuuuguacacuuagggauauauauauauagcuacauucacacacucacaau

SEQ ID NO: 755353 - RNA, 64 nt, hsa
agugauguuuguguguuuuguacacuuagggauauauauauauagcuacauucacacacucaca

SEQ ID NO: 755354 - RNA, 64 nt, hsa
aaagugauguuuguguguuuuguacacuuagggauauauauauauagcuacauucacacacuca

SEQ ID NO: 755355 - RNA, 64 nt, hsa
ucuuauucugugccaggcaacaugcuaacugcuguauauauauuauuauauuuguacuuuggca

SEQ ID NO: 755356 - RNA, 64 nt, hsa
uucagauugccuagcuauuugaacaucucaaaguuauauauacuggguauuaaaauuaaaagca

SEQ ID NO: 755357 - RNA, 64 nt, hsa
aagacuauguacccacaccauacauacauacauauauauauacacauacauacaaaccugugug

SEQ ID NO: 755358 - RNA, 64 nt, hsa
uuaagacuauguacccacaccauacauacauacauauauauauacacauacauacaaaccugug

SEQ ID NO: 755359 - RNA, 64 nt, hsa
ggccuggaaagaaagggaaaguggauuuaaaauauauauauacguaacccaagccccauaaccc

SEQ ID NO: 755360 - RNA, 64 nt, hsa
ggggccuggaaagaaagggaaaguggauuuaaaauauauauauacguaacccaagccccauaac

SEQ ID NO: 755361 - RNA, 64 nt, hsa
uauuuauaaugcauuuauagaaaaaguauauauauauauauaaaaugaaugcagauugcgaagg

SEQ ID NO: 755362 - RNA, 64 nt, hsa
aauauuuauaaugcauuuauagaaaaaguauauauauauauauaaaaugaaugcagauugcgaa

SEQ ID NO: 755363 - RNA, 64 nt, hsa
aaaauauuuauaaugcauuuauagaaaaaguauauauauauauauaaaaugaaugcagauugcg

SEQ ID NO: 755364 - RNA, 64 nt, hsa
auaaaauauuuauaaugcauuuauagaaaaaguauauauauauauauaaaaugaaugcagauug

SEQ ID NO: 755365 - RNA, 64 nt, hsa
ugauaaaauauuuauaaugcauuuauagaaaaaguauauauauauauauaaaaugaaugcagau

SEQ ID NO: 755366 - RNA, 64 nt, hsa
augaaguauugcuuaaauuuuagguauaaauaaauauauauauguauaauauauauuccaaugu

SEQ ID NO: 755367 - RNA, 64 nt, hsa
gucccaucuacugaauagaaaacuuugagaauaauauauauauauauuuuaaauguuuucacug

SEQ ID NO: 755368 - RNA, 64 nt, hsa
cccaucuacugaauagaaaacuuugagaauaauauauauauauauuuuaaauguuuucacugac

SEQ ID NO: 755369 - RNA, 64 nt, hsa
caucuacugaauagaaaacuuugagaauaauauauauauauauuuuaaauguuuucacugacuc

SEQ ID NO: 755370 - RNA, 64 nt, hsa
gugaaauaaacaaugauuugcuuuucagugagaauauauauaugagauauauauagauauauau

SEQ ID NO: 755371 - RNA, 64 nt, hsa
ugauuugcuuuucagugagaauauauauaugagauauauauagauauauauucuagguugggug

SEQ ID NO: 755372 - RNA, 64 nt, hsa
uggaaaaacagucuuguauuuuucuguauguguguauauauauauaauuauguacuucuggcaa

SEQ ID NO: 755373 - RNA, 64 nt, hsa
gaaaaacagucuuguauuuuucuguauguguguauauauauauaauuauguacuucuggcaauu

SEQ ID NO: 755374 - RNA, 64 nt, hsa
aaaacagucuuguauuuuucuguauguguguauauauauauaauuauguacuucuggcaauucu

SEQ ID NO: 755375 - RNA, 64 nt, hsa
ccagccuagcccuugucccuuuuaauauaaaagauauauauauauauauauauauauaaaauau

SEQ ID NO: 755376 - RNA, 64 nt, hsa
agccuagcccuugucccuuuuaauauaaaagauauauauauauauauauauauauaaaauaucu

SEQ ID NO: 755377 - RNA, 64 nt, hsa
ccuagcccuugucccuuuuaauauaaaagauauauauauauauauauauauauaaaauaucuau

SEQ ID NO: 755378 - RNA, 64 nt, hsa
uagcccuugucccuuuuaauauaaaagauauauauauauauauauauauauaaaauaucuauau

SEQ ID NO: 755379 - RNA, 64 nt, hsa
gcccuugucccuuuuaauauaaaagauauauauauauauauauauauauaaaauaucuauauuc

SEQ ID NO: 755380 - RNA, 64 nt, hsa
ccuugucccuuuuaauauaaaagauauauauauauauauauauauauaaaauaucuauauucua

SEQ ID NO: 755381 - RNA, 64 nt, hsa
uugucccuuuuaauauaaaagauauauauauauauauauauauauaaaauaucuauauucuaua

SEQ ID NO: 755382 - RNA, 64 nt, hsa
gucccuuuuaauauaaaagauauauauauauauauauauauauaaaauaucuauauucuauaca

SEQ ID NO: 755383 - RNA, 64 nt, hsa
cccuuuuaauauaaaagauauauauauauauauauauauauaaaauaucuauauucuauacaca

SEQ ID NO: 755384 - RNA, 64 nt, hsa
uaucuauugaaaauauauauuauauacauagacauauauauauauauaauaggcuguauauauu

SEQ ID NO: 755385 - RNA, 64 nt, hsa
ucuauugaaaauauauauuauauacauagacauauauauauauauaauaggcuguauauauugc

SEQ ID NO: 755386 - RNA, 64 nt, hsa
uauugaaaauauauauuauauacauagacauauauauauauauaauaggcuguauauauugcuc

SEQ ID NO: 755387 - RNA, 64 nt, hsa
uugaaaauauauauuauauacauagacauauauauauauauaauaggcuguauauauugcucag

SEQ ID NO: 755388 - RNA, 64 nt, hsa
gggacuggugauauguugaucuuuuucaaaaaaauauauauaugacaaaaaaaaaaaaaaagga

SEQ ID NO: 755389 - RNA, 64 nt, hsa
gaaauuauguuuucauguguuucacaugaaaaaguauauauauacaaaguuaauauagugggua

SEQ ID NO: 755390 - RNA, 64 nt, hsa
aauuauguuuucauguguuucacaugaaaaaguauauauauacaaaguuaauauaguggguaaa

SEQ ID NO: 755391 - RNA, 64 nt, hsa
aucuauaguuacuuuguaccauuugaaauauauguauauauauauauauaauauuuugaaauau

SEQ ID NO: 755392 - RNA, 64 nt, hsa
cuauaguuacuuuguaccauuugaaauauauguauauauauauauauaauauuuugaaauauua

SEQ ID NO: 755393 - RNA, 64 nt, hsa
auaguuacuuuguaccauuugaaauauauguauauauauauauauaauauuuugaaauauuauc

SEQ ID NO: 755394 - RNA, 64 nt, hsa
aguuacuuuguaccauuugaaauauauguauauauauauauauaauauuuugaaauauuaucua

SEQ ID NO: 755395 - RNA, 64 nt, hsa
uuacuuuguaccauuugaaauauauguauauauauauauauaauauuuugaaauauuaucuauu

SEQ ID NO: 755396 - RNA, 64 nt, hsa
aaauaauaaaccucacuuuacuuguuaaaagggauauauauauauauauauaugucugcaacuu

SEQ ID NO: 755397 - RNA, 64 nt, hsa
auaauaaaccucacuuuacuuguuaaaagggauauauauauauauauauaugucugcaacuuca

SEQ ID NO: 755398 - RNA, 64 nt, hsa
aauaaaccucacuuuacuuguuaaaagggauauauauauauauauauaugucugcaacuucagg

SEQ ID NO: 755399 - RNA, 64 nt, hsa
uaaaccucacuuuacuuguuaaaagggauauauauauauauauauaugucugcaacuucaggga

SEQ ID NO: 755400 - RNA, 64 nt, hsa
aaccucacuuuacuuguuaaaagggauauauauauauauauauaugucugcaacuucagggaga

SEQ ID NO: 755401 - RNA, 64 nt, hsa
ccucacuuuacuuguuaaaagggauauauauauauauauauaugucugcaacuucagggagaaa

SEQ ID NO: 755402 - RNA, 64 nt, hsa
gcagugucaccacugguguaagcuacuauauauguauauauauauguaguaaaccacuuuuugu

SEQ ID NO: 755403 - RNA, 64 nt, hsa
agugucaccacugguguaagcuacuauauauguauauauauauguaguaaaccacuuuuuguaa

SEQ ID NO: 755404 - RNA, 64 nt, hsa
acaauaaggauaauacuuuauauaauguauaaaguauauauaauauaauauauauguuauauaa

SEQ ID NO: 755405 - RNA, 64 nt, hsa
ucugucaaaccuuuuaaguugacaacaugacucauauauauacauguguauaagaugagcaugu

SEQ ID NO: 755406 - RNA, 64 nt, hsa
aguguaaguuguuuucgcuguuaaauuggauauuuauauauauauauagcaagauuuucaugug

SEQ ID NO: 755407 - RNA, 64 nt, hsa
uguaaguuguuuucgcuguuaaauuggauauuuauauauauauauagcaagauuuucauguguu

SEQ ID NO: 755408 - RNA, 64 nt, hsa
uaaguuguuuucgcuguuaaauuggauauuuauauauauauauagcaagauuuucauguguuau

SEQ ID NO: 755409 - RNA, 64 nt, hsa
aguuguuuucgcuguuaaauuggauauuuauauauauauauagcaagauuuucauguguuauuu

SEQ ID NO: 755410 - RNA, 64 nt, hsa
ccacuaguuuuaauauaguacaaugaaaaaauaauauauauauauauaguacaaugguccagac

SEQ ID NO: 755411 - RNA, 64 nt, hsa
acuaguuuuaauauaguacaaugaaaaaauaauauauauauauauaguacaaugguccagacau

SEQ ID NO: 755412 - RNA, 64 nt, hsa
uaguuuuaauauaguacaaugaaaaaauaauauauauauauauaguacaaugguccagacauaa

SEQ ID NO: 755413 - RNA, 64 nt, hsa
guuuuaauauaguacaaugaaaaaauaauauauauauauauaguacaaugguccagacauaaua

SEQ ID NO: 755414 - RNA, 64 nt, hsa
gagagaaugcauucuuaaaagaaagcuguacauguauauauaugcauauauauauauguggcuc

SEQ ID NO: 755415 - RNA, 64 nt, hsa
ucuuaaaagaaagcuguacauguauauauaugcauauauauauauguggcucuagccucaggcu

SEQ ID NO: 755416 - RNA, 64 nt, hsa
uuaaaagaaagcuguacauguauauauaugcauauauauauauguggcucuagccucaggcucc

SEQ ID NO: 755417 - RNA, 64 nt, hsa
aaacuguucauaaaaauuuccauaauaaaaguucuauauauauauaaauauauacauacauaug

SEQ ID NO: 755418 - RNA, 64 nt, hsa
acuguucauaaaaauuuccauaauaaaaguucuauauauauauaaauauauacauacauaugag

SEQ ID NO: 755419 - RNA, 64 nt, hsa
uguucauaaaaauuuccauaauaaaaguucuauauauauauaaauauauacauacauaugagaa

SEQ ID NO: 755420 - RNA, 64 nt, hsa
cucucaauacagauaaacucacacauacuggagauauauauauaauagauauauauaaaauuau

SEQ ID NO: 755421 - RNA, 64 nt, hsa
cucaauacagauaaacucacacauacuggagauauauauauaauagauauauauaaaauuauuu

SEQ ID NO: 755422 - RNA, 64 nt, hsa
aacucacacauacuggagauauauauauaauagauauauauaaaauuauuuuaaugcauuguag

SEQ ID NO: 755423 - RNA, 64 nt, hsa
uuuauaaagcauguucacccuuauagucuaagacuauauauauaaauguauaaauauacaguau

SEQ ID NO: 755424 - RNA, 64 nt, hsa
uauaaagcauguucacccuuauagucuaagacuauauauauaaauguauaaauauacaguauag

SEQ ID NO: 755425 - RNA, 64 nt, hsa
gugguaaauaucuauguuacauguagauuauacauauauauacacacguguauaugagauauau

SEQ ID NO: 755426 - RNA, 64 nt, hsa
gagauauauaucuuauaucuccacaaacacaaauuauauauauacauauccacacacauacauu

SEQ ID NO: 755427 - RNA, 64 nt, hsa
gauauauaucuuauaucuccacaaacacaaauuauauauauacauauccacacacauacauuac

SEQ ID NO: 755428 - RNA, 64 nt, hsa
auaucuguguauauaaauccacaugcacaugaaauauauauauauauauaauuugugugugugu

SEQ ID NO: 755429 - RNA, 64 nt, hsa
aucuguguauauaaauccacaugcacaugaaauauauauauauauauaauuuguguguguguau

SEQ ID NO: 755430 - RNA, 64 nt, hsa
cuguguauauaaauccacaugcacaugaaauauauauauauauauaauuuguguguguguaugu

SEQ ID NO: 755431 - RNA, 64 nt, hsa
guguauauaaauccacaugcacaugaaauauauauauauauauaauuuguguguguguaugugu

SEQ ID NO: 755432 - RNA, 64 nt, hsa
guauauaaauccacaugcacaugaaauauauauauauauauaauuuguguguguguauguguau

SEQ ID NO: 755433 - RNA, 64 nt, hsa
uacguauguacgugucuguagguguguguauauauauauauauuuaugcaucuauauacauaua

SEQ ID NO: 755434 - RNA, 64 nt, hsa
uauacguauguacgugucuguagguguguguauauauauauauauuuaugcaucuauauacaua

SEQ ID NO: 755435 - RNA, 64 nt, hsa
uguauacguauguacgugucuguagguguguguauauauauauauauuuaugcaucuauauaca

SEQ ID NO: 755436 - RNA, 64 nt, hsa
cauguauacguauguacgugucuguagguguguguauauauauauauauuuaugcaucuauaua

SEQ ID NO: 755437 - RNA, 64 nt, hsa
uauagauagguagauauauauauauauauauaaauauauauacauggauauauaaaguuucuuu

SEQ ID NO: 755438 - RNA, 64 nt, hsa
uauacguccauauagauagguagauauauauauauauauauaaauauauauacauggauauaua

SEQ ID NO: 755439 - RNA, 64 nt, hsa
uguauacguccauauagauagguagauauauauauauauauauaaauauauauacauggauaua

SEQ ID NO: 755440 - RNA, 64 nt, hsa
acuguauacguccauauagauagguagauauauauauauauauauaaauauauauacauggaua

SEQ ID NO: 755441 - RNA, 64 nt, hsa
agacuguauacguccauauagauagguagauauauauauauauauauaaauauauauacaugga

SEQ ID NO: 755442 - RNA, 64 nt, hsa
cgagacuguauacguccauauagauagguagauauauauauauauauauaaauauauauacaug

SEQ ID NO: 755443 - RNA, 64 nt, hsa
uccgagacuguauacguccauauagauagguagauauauauauauauauauaaauauauauaca

SEQ ID NO: 755444 - RNA, 64 nt, hsa
acacacacauacauauguguguguauaguauauauauauauacacacauauauguuucuguguu

SEQ ID NO: 755445 - RNA, 64 nt, hsa
auacacacacauacauauguguguguauaguauauauauauauacacacauauauguuucugug

SEQ ID NO: 755446 - RNA, 64 nt, hsa
auauacacacacauacauauguguguguauaguauauauauauauacacacauauauguuucug

SEQ ID NO: 755447 - RNA, 64 nt, hsa
auauauacacacacauacauauguguguguauaguauauauauauauacacacauauauguuuc

SEQ ID NO: 755448 - RNA, 64 nt, hsa
guuucugugauauacauauauacauauauauguauauauauacacacacauacauaugugugug

SEQ ID NO: 755449 - RNA, 64 nt, hsa
auguuucugugauauacauauauacauauauauguauauauauacacacacauacauaugugug

SEQ ID NO: 755450 - RNA, 64 nt, hsa
uauauauauauauacacacacacacauauauauauauauauaauucaaagcacaauaauugaaa

SEQ ID NO: 755451 - RNA, 64 nt, hsa
uauauauauauauauacacacacacacauauauauauauauauaauucaaagcacaauaauuga

SEQ ID NO: 755452 - RNA, 64 nt, hsa
uauauauauauauauauacacacacacacauauauauauauauauaauucaaagcacaauaauu

SEQ ID NO: 755453 - RNA, 64 nt, hsa
uauauauauauauauauauacacacacacacauauauauauauauauaauucaaagcacaauaa

SEQ ID NO: 755454 - RNA, 64 nt, hsa
auuauauauauauauauauauacacacacacacauauauauauauauauaauucaaagcacaau

SEQ ID NO: 755455 - RNA, 64 nt, hsa
auccauucucaaaaguuaaaauuauauauauauauauauauacacacacacacauauauauaua

SEQ ID NO: 755456 - RNA, 64 nt, hsa
uuauccauucucaaaaguuaaaauuauauauauauauauauauacacacacacacauauauaua

SEQ ID NO: 755457 - RNA, 64 nt, hsa
aauuauccauucucaaaaguuaaaauuauauauauauauauauauacacacacacacauauaua

SEQ ID NO: 755458 - RNA, 64 nt, hsa
aaaauuauccauucucaaaaguuaaaauuauauauauauauauauauacacacacacacauaua

SEQ ID NO: 755459 - RNA, 64 nt, hsa
uuaaaauuauccauucucaaaaguuaaaauuauauauauauauauauauacacacacacacaua

SEQ ID NO: 755460 - RNA, 64 nt, hsa
aguuaaaauuauccauucucaaaaguuaaaauuauauauauauauauauauacacacacacaca

SEQ ID NO: 755461 - RNA, 64 nt, hsa
aaaguuaaaauuauccauucucaaaaguuaaaauuauauauauauauauauauacacacacaca

SEQ ID NO: 755462 - RNA, 64 nt, hsa
uaacaaucuuuggauuugucuauacauauauauauauauauauggcuuugccuuaauauacccc

SEQ ID NO: 755463 - RNA, 64 nt, hsa
aguaacaaucuuuggauuugucuauacauauauauauauauauauggcuuugccuuaauauacc

SEQ ID NO: 755464 - RNA, 64 nt, hsa
gaaguaacaaucuuuggauuugucuauacauauauauauauauauauggcuuugccuuaauaua

SEQ ID NO: 755465 - RNA, 64 nt, hsa
aagaaguaacaaucuuuggauuugucuauacauauauauauauauauauggcuuugccuuaaua

SEQ ID NO: 755466 - RNA, 64 nt, hsa
uaaagaaguaacaaucuuuggauuugucuauacauauauauauauauauauggcuuugccuuaa

SEQ ID NO: 755467 - RNA, 64 nt, hsa
acccuuucacaagcuaccaucucagauauauauauauauauaaauucaauaaagcuuucuguuu

SEQ ID NO: 755468 - RNA, 64 nt, hsa
cuacccuuucacaagcuaccaucucagauauauauauauauauaaauucaauaaagcuuucugu

SEQ ID NO: 755469 - RNA, 64 nt, hsa
uacuacccuuucacaagcuaccaucucagauauauauauauauauaaauucaauaaagcuuucu

SEQ ID NO: 755470 - RNA, 64 nt, hsa
auuacuacccuuucacaagcuaccaucucagauauauauauauauauaaauucaauaaagcuuu

SEQ ID NO: 755471 - RNA, 64 nt, hsa
caauuacuacccuuucacaagcuaccaucucagauauauauauauauauaaauucaauaaagcu

SEQ ID NO: 755472 - RNA, 64 nt, hsa
uaauuuaacugagaaagaaagccuuuuucauauauauauauauuggauuucuaaggaugguggu

SEQ ID NO: 755473 - RNA, 64 nt, hsa
ucuaauuuaacugagaaagaaagccuuuuucauauauauauauauuggauuucuaaggauggug

SEQ ID NO: 755474 - RNA, 64 nt, hsa
uaucuaauuuaacugagaaagaaagccuuuuucauauauauauauauuggauuucuaaggaugg

SEQ ID NO: 755475 - RNA, 64 nt, hsa
gaucuucccaauacaagaaaauuaauaaaaaauuuauauauaggcagcagcaaaagagccaugu

SEQ ID NO: 755476 - RNA, 64 nt, hsa
agucuuuuguacauaacauauauauauauauacauauauauaaauauaaauauaaauauaucuc

SEQ ID NO: 755477 - RNA, 64 nt, hsa
gauaucucaaagucuuuuguacauaacauauauauauauauacauauauauaaauauaaauaua

SEQ ID NO: 755478 - RNA, 64 nt, hsa
cugauaucucaaagucuuuuguacauaacauauauauauauauacauauauauaaauauaaaua

SEQ ID NO: 755479 - RNA, 64 nt, hsa
gccugauaucucaaagucuuuuguacauaacauauauauauauauacauauauauaaauauaaa

SEQ ID NO: 755480 - RNA, 64 nt, hsa
gugccugauaucucaaagucuuuuguacauaacauauauauauauauacauauauauaaauaua

SEQ ID NO: 755481 - RNA, 64 nt, hsa
uuuugauauaacuauauauauauaaauauaaaauuauauauaaaggguuauuugaaaccaaucc

SEQ ID NO: 755482 - RNA, 64 nt, hsa
uauacuauguacuaucaguuuugauauaacuauauauauauaaauauaaaauuauauauaaagg

SEQ ID NO: 755483 - RNA, 64 nt, hsa
guuauacuauguacuaucaguuuugauauaacuauauauauauaaauauaaaauuauauauaaa

SEQ ID NO: 755484 - RNA, 64 nt, hsa
caguuauacuauguacuaucaguuuugauauaacuauauauauauaaauauaaaauuauauaua

SEQ ID NO: 755485 - RNA, 64 nt, hsa
aaaacauaacuuuguaaauauuacccuguaauauuauauauacuuaauaaaacauuuuaagcua

SEQ ID NO: 755486 - RNA, 64 nt, hsa
aaaaaauauguauacacaaauauauacguauaucuauauauacguauguauauacacacaugua

SEQ ID NO: 755487 - RNA, 64 nt, hsa
gacgauuucucagcagggccuauguuuauauauauauauauauuuauucuuuaguuuuugugau

SEQ ID NO: 755488 - RNA, 64 nt, hsa
augacgauuucucagcagggccuauguuuauauauauauauauauuuauucuuuaguuuuugug

SEQ ID NO: 755489 - RNA, 64 nt, hsa
uuaugacgauuucucagcagggccuauguuuauauauauauauauauuuauucuuuaguuuuug

SEQ ID NO: 755490 - RNA, 64 nt, hsa
auuuaugacgauuucucagcagggccuauguuuauauauauauauauauuuauucuuuaguuuu

SEQ ID NO: 755491 - RNA, 64 nt, hsa
gaauuuaugacgauuucucagcagggccuauguuuauauauauauauauauuuauucuuuaguu

SEQ ID NO: 755492 - RNA, 64 nt, hsa
auuccaaaaccugcugcaucauaauaaauauaucuauauauauuuagcauaagacgugauauuu

SEQ ID NO: 755493 - RNA, 64 nt, hsa
uuuaauucauaacgucucuuggucacagaugccuuauauauaaaauaaguugccagaucucuaa

SEQ ID NO: 755494 - RNA, 64 nt, hsa
caguugacuagaaucgacaaauuguuacuccauauauauauaugugugugugugugugugugug

SEQ ID NO: 755495 - RNA, 64 nt, hsa
ggcaguugacuagaaucgacaaauuguuacuccauauauauauaugugugugugugugugugug

SEQ ID NO: 755496 - RNA, 64 nt, hsa
uggucaugcccacucuuugggaguauauucccuuuauauauauugaguauuguaccacuugaga

SEQ ID NO: 755497 - RNA, 64 nt, hsa
cuugauguuauauguagagauauauauauauauauauauauaccauaaaagcaauauguucucu

SEQ ID NO: 755498 - RNA, 64 nt, hsa
gacuugauguuauauguagagauauauauauauauauauauauaccauaaaagcaauauguucu

SEQ ID NO: 755499 - RNA, 64 nt, hsa
augacuugauguuauauguagagauauauauauauauauauauauaccauaaaagcaauauguu

SEQ ID NO: 755500 - RNA, 64 nt, hsa
gcaugacuugauguuauauguagagauauauauauauauauauauauaccauaaaagcaauaug

SEQ ID NO: 755501 - RNA, 64 nt, hsa
gugcaugacuugauguuauauguagagauauauauauauauauauauauaccauaaaagcaaua

SEQ ID NO: 755502 - RNA, 64 nt, hsa
augugcaugacuugauguuauauguagagauauauauauauauauauauauaccauaaaagcaa

SEQ ID NO: 755503 - RNA, 64 nt, hsa
uaaugugcaugacuugauguuauauguagagauauauauauauauauauauauaccauaaaagc

SEQ ID NO: 755504 - RNA, 64 nt, hsa
cuuaaugugcaugacuugauguuauauguagagauauauauauauauauauauauaccauaaaa

SEQ ID NO: 755505 - RNA, 64 nt, hsa
agaugcauagauaugggauuauguaugauauauauauauauacacacacacacaaagggauaga

SEQ ID NO: 755506 - RNA, 64 nt, hsa
auagaugcauagauaugggauuauguaugauauauauauauauacacacacacacaaagggaua

SEQ ID NO: 755507 - RNA, 64 nt, hsa
guauagaugcauagauaugggauuauguaugauauauauauauauacacacacacacaaaggga

SEQ ID NO: 755508 - RNA, 64 nt, hsa
ggguauagaugcauagauaugggauuauguaugauauauauauauauacacacacacacaaagg

SEQ ID NO: 755509 - RNA, 64 nt, hsa
uauauguguguguguauauauauauauauauacauauauauaaaaagguuugauccaucaagcu

SEQ ID NO: 755510 - RNA, 64 nt, hsa
uauauauauauauauguguguguguauauauauauauauauacauauauauaaaaagguuugau

SEQ ID NO: 755511 - RNA, 64 nt, hsa
gauauauauauauauauguguguguguauauauauauauauauacauauauauaaaaagguuug

SEQ ID NO: 755512 - RNA, 64 nt, hsa
gagauauauauauauauauguguguguguauauauauauauauauacauauauauaaaaagguu

SEQ ID NO: 755513 - RNA, 64 nt, hsa
cugagauauauauauauauauguguguguguauauauauauauauauacauauauauaaaaagg

SEQ ID NO: 755514 - RNA, 64 nt, hsa
cacugagauauauauauauauauguguguguguauauauauauauauauacauauauauaaaaa

SEQ ID NO: 755515 - RNA, 64 nt, hsa
agcacugagauauauauauauauauguguguguguauauauauauauauauacauauauauaaa

SEQ ID NO: 755516 - RNA, 64 nt, hsa
ggaaguuagguacaaugcagcacugagauauauauauauauauguguguguguauauauauaua

SEQ ID NO: 755517 - RNA, 64 nt, hsa
guggaaguuagguacaaugcagcacugagauauauauauauauauguguguguguauauauaua

SEQ ID NO: 755518 - RNA, 64 nt, hsa
uuguggaaguuagguacaaugcagcacugagauauauauauauauauguguguguguauauaua

SEQ ID NO: 755519 - RNA, 64 nt, hsa
uguuguggaaguuagguacaaugcagcacugagauauauauauauauauguguguguguauaua

SEQ ID NO: 755520 - RNA, 64 nt, hsa
gauuuuuuggagaacaucugcacuuucuuauauauauauauaauauuaaaaaaagcaacugggu

SEQ ID NO: 755521 - RNA, 64 nt, hsa
aagauuuuuuggagaacaucugcacuuucuuauauauauauauaauauuaaaaaaagcaacugg

SEQ ID NO: 755522 - RNA, 64 nt, hsa
ccaagauuuuuuggagaacaucugcacuuucuuauauauauauauaauauuaaaaaaagcaacu

SEQ ID NO: 755523 - RNA, 64 nt, hsa
ugccaagauuuuuuggagaacaucugcacuuucuuauauauauauauaauauuaaaaaaagcaa

SEQ ID NO: 755524 - RNA, 64 nt, hsa
aaaaauuuuuaaaagauauauauaucuauauaucuauauauauguacuguuuuguuuccugucu

SEQ ID NO: 755525 - RNA, 64 nt, hsa
agaggaacuucaauuaugaaaaauuuuuaaaagauauauauaucuauauaucuauauauaugua

SEQ ID NO: 755526 - RNA, 64 nt, hsa
cacagaacuagucugcgcuuaccuuacccauguuuauauauagcuguccuacagggagcuuuua

SEQ ID NO: 755527 - RNA, 64 nt, hsa
aagaggaagauaauggagaaugagaacauauauauauauauauuaagccccaggcugaauacuc

SEQ ID NO: 755528 - RNA, 64 nt, hsa
aaaagaggaagauaauggagaaugagaacauauauauauauauauuaagccccaggcugaauac

SEQ ID NO: 755529 - RNA, 64 nt, hsa
aaaaaagaggaagauaauggagaaugagaacauauauauauauauauuaagccccaggcugaau

SEQ ID NO: 755530 - RNA, 64 nt, hsa
aaaaaaaagaggaagauaauggagaaugagaacauauauauauauauauuaagccccaggcuga

SEQ ID NO: 755531 - RNA, 64 nt, hsa
guaaauauauaaauauauauauauauaaaauaaauauauauaaaccuaaaaaagauauauuaaa

SEQ ID NO: 755532 - RNA, 64 nt, hsa
auauauggcagaguuguaaauauauaaauauauauauauauaaaauaaauauauauaaaccuaa

SEQ ID NO: 755533 - RNA, 64 nt, hsa
gaauauauggcagaguuguaaauauauaaauauauauauauauaaaauaaauauauauaaaccu

SEQ ID NO: 755534 - RNA, 64 nt, hsa
aggaauauauggcagaguuguaaauauauaaauauauauauauauaaaauaaauauauauaaac

SEQ ID NO: 755535 - RNA, 64 nt, hsa
gaaggaauauauggcagaguuguaaauauauaaauauauauauauauaaaauaaauauauauaa

SEQ ID NO: 755536 - RNA, 64 nt, hsa
ugaagauguuuauugguauauuuucuuuuucgucuauauauacauauguaacagucaaauauca

SEQ ID NO: 755537 - RNA, 64 nt, hsa
gggaaggggugcuccuuaaauauauauagauauguauauauacauguuuuucuauuaaaaauag

SEQ ID NO: 755538 - RNA, 64 nt, hsa
ucauacucaacugggggaaggggugcuccuuaaauauauauagauauguauauauacauguuuu

SEQ ID NO: 755539 - RNA, 64 nt, hsa
augaacagacuucuaaaauaacgucuguauauuuuauauauagauacauauaugaaagaaggcu

SEQ ID NO: 755540 - RNA, 64 nt, hsa
uuagagacugauuagacugaaaaugccuaaucgauauauauauucuugugccuaguacuuuacc

SEQ ID NO: 755541 - RNA, 64 nt, hsa
ggcaaagccuucaaaugcuugucacaucuuacuguauauauauaauuccuacugaagaaauccc

SEQ ID NO: 755542 - RNA, 64 nt, hsa
caaagccuucaaaugcuugucacaucuuacuguauauauauaauuccuacugaagaaauccccu

SEQ ID NO: 755543 - RNA, 64 nt, hsa
uguacauuucuauaaauagaugcuguguauaugguauauauacauauauauauauaacauauau

SEQ ID NO: 755544 - RNA, 64 nt, hsa
uauaaauagaugcuguguauaugguauauauacauauauauauauaacauauauggaagaggaa

SEQ ID NO: 755545 - RNA, 64 nt, hsa
uaaauagaugcuguguauaugguauauauacauauauauauauaacauauauggaagaggaaaa

SEQ ID NO: 755546 - RNA, 64 nt, hsa
aauagaugcuguguauaugguauauauacauauauauauauaacauauauggaagaggaaaagg

SEQ ID NO: 755547 - RNA, 64 nt, hsa
gugcagguuccgauguuauuagauguuacaaguuuauauauaucuauauauauaauuuauugag

SEQ ID NO: 755548 - RNA, 64 nt, hsa
cgauguuauuagauguuacaaguuuauauauaucuauauauauaauuuauugaguuuuuacaag

SEQ ID NO: 755549 - RNA, 64 nt, hsa
auguuauuagauguuacaaguuuauauauaucuauauauauaauuuauugaguuuuuacaagau

SEQ ID NO: 755550 - RNA, 64 nt, hsa
auuuguccauagcaaacauauguguguguguguguauauauauauguggguugccaauguuugg

SEQ ID NO: 755551 - RNA, 64 nt, hsa
uuguccauagcaaacauauguguguguguguguauauauauauguggguugccaauguuugguu

SEQ ID NO: 755552 - RNA, 64 nt, hsa
augugauacuggaauaugggauacuuuucauguuuauauauauauauauauguauauauauaua

SEQ ID NO: 755553 - RNA, 64 nt, hsa
gugauacuggaauaugggauacuuuucauguuuauauauauauauauauguauauauauauaca

SEQ ID NO: 755554 - RNA, 64 nt, hsa
gauacuggaauaugggauacuuuucauguuuauauauauauauauauguauauauauauacaua

SEQ ID NO: 755555 - RNA, 64 nt, hsa
uacuggaauaugggauacuuuucauguuuauauauauauauauauguauauauauauacauaua

SEQ ID NO: 755556 - RNA, 64 nt, hsa
cuggaauaugggauacuuuucauguuuauauauauauauauauguauauauauauacauauaua

SEQ ID NO: 755557 - RNA, 64 nt, hsa
ggauacuuuucauguuuauauauauauauauauguauauauauauacauauauauauauauaua

SEQ ID NO: 755558 - RNA, 64 nt, hsa
auacuuuucauguuuauauauauauauauauguauauauauauacauauauauauauauauaaa

SEQ ID NO: 755559 - RNA, 64 nt, hsa
acuuuucauguuuauauauauauauauauguauauauauauacauauauauauauauauaaaca

SEQ ID NO: 755560 - RNA, 64 nt, hsa
uuuauauauauauauauauguauauauauauacauauauauauauauauaaacaugaaauauau

SEQ ID NO: 755561 - RNA, 64 nt, hsa
uauauauauauauauauguauauauauauacauauauauauauauauaaacaugaaauauauau

SEQ ID NO: 755562 - RNA, 64 nt, hsa
uauauauauauauauguauauauauauacauauauauauauauauaaacaugaaauauauauau

SEQ ID NO: 755563 - RNA, 64 nt, hsa
uauauauauauauguauauauauauacauauauauauauauauaaacaugaaauauauauauau

SEQ ID NO: 755564 - RNA, 64 nt, hsa
uauauauauauguauauauauauacauauauauauauauauaaacaugaaauauauauauaugg

SEQ ID NO: 755565 - RNA, 64 nt, hsa
auauauacauauauauauauauauaaacaugaaauauauauauauggcuccuuugugccccaug

SEQ ID NO: 755566 - RNA, 64 nt, hsa
auauacauauauauauauauauaaacaugaaauauauauauauggcuccuuugugccccauguc

SEQ ID NO: 755567 - RNA, 64 nt, hsa
auuuccucuuuuggauaggucuuuaaccaguucauauauauacuuugucaaauauauggaugug

SEQ ID NO: 755568 - RNA, 64 nt, hsa
agaauuguuagcaaaugacagauuucuguaagccuauauauauagucaaaucgauuuaguaagu

SEQ ID NO: 755569 - RNA, 64 nt, hsa
aauuguuagcaaaugacagauuucuguaagccuauauauauagucaaaucgauuuaguaaguau

SEQ ID NO: 755570 - RNA, 64 nt, hsa
aaacaaguaaauauauauggucauauacauauuguauauauauucauauacaaacauguaugua

SEQ ID NO: 755571 - RNA, 64 nt, hsa
uuagucuaacucccccauuuuacagauuucucacuauauauauuucuagaaggggcuaugcaua

SEQ ID NO: 755572 - RNA, 64 nt, hsa
uugcugaggaaaugaagauaagcaaaaauauaaauauauauauaaauauaugaguuauuaaaau

SEQ ID NO: 755573 - RNA, 64 nt, hsa
gcugaggaaaugaagauaagcaaaaauauaaauauauauauaaauauaugaguuauuaaaauca

SEQ ID NO: 755574 - RNA, 64 nt, hsa
ugucaguauuuuuguaauuauuucuaccuccaaauauauauauauugucuuucacuggauaaug

SEQ ID NO: 755575 - RNA, 64 nt, hsa
ucaguauuuuuguaauuauuucuaccuccaaauauauauauauugucuuucacuggauaaugug

SEQ ID NO: 755576 - RNA, 64 nt, hsa
auaguguuuuacguuuuuuauccugcugaaaaaguauauauaaaauaucuaacauuacaggaua

SEQ ID NO: 755577 - RNA, 64 nt, hsa
ugagcaaauaagauuaaguaaaacaaaucaauuguauauauaauugaccuuuuuguggaacaug

SEQ ID NO: 755578 - RNA, 64 nt, hsa
aagauggcagauuuucugcauuuacacuguauauuauauauauauuuuuauugugguucuuacc

SEQ ID NO: 755579 - RNA, 64 nt, hsa
gauggcagauuuucugcauuuacacuguauauuauauauauauuuuuauugugguucuuacccc

SEQ ID NO: 755580 - RNA, 64 nt, hsa
guacagcagaaaaucuuuuacuaguguguguguguauauauauaaacaauuguaaauuucuuuu

SEQ ID NO: 755581 - RNA, 64 nt, hsa
acagcagaaaaucuuuuacuaguguguguguguauauauauaaacaauuguaaauuucuuuuag

SEQ ID NO: 755582 - RNA, 64 nt, hsa
uauguauacaugauuaggguaagauagaauguauuauauauauauauauauacacacacacaua

SEQ ID NO: 755583 - RNA, 64 nt, hsa
uguauacaugauuaggguaagauagaauguauuauauauauauauauauacacacacacauaua

SEQ ID NO: 755584 - RNA, 64 nt, hsa
uauacaugauuaggguaagauagaauguauuauauauauauauauauacacacacacauauaua

SEQ ID NO: 755585 - RNA, 64 nt, hsa
uacaugauuaggguaagauagaauguauuauauauauauauauauacacacacacauauauaua

SEQ ID NO: 755586 - RNA, 64 nt, hsa
caugauuaggguaagauagaauguauuauauauauauauauauacacacacacauauauauagc

SEQ ID NO: 755587 - RNA, 64 nt, hsa
ugauuaggguaagauagaauguauuauauauauauauauauacacacacacauauauauagcug

SEQ ID NO: 755588 - RNA, 64 nt, hsa
auguauuauauauauauauauauacacacacacauauauauagcugaaucuuugguguauugaa

SEQ ID NO: 755589 - RNA, 64 nt, hsa
aaauagcagugaauuuuagucauuaacuucaaaauauauauauauauauaauuuaaaggaaaaa

SEQ ID NO: 755590 - RNA, 64 nt, hsa
auagcagugaauuuuagucauuaacuucaaaauauauauauauauauaauuuaaaggaaaaaua

SEQ ID NO: 755591 - RNA, 64 nt, hsa
agcagugaauuuuagucauuaacuucaaaauauauauauauauauaauuuaaaggaaaaauagg

SEQ ID NO: 755592 - RNA, 64 nt, hsa
cagugaauuuuagucauuaacuucaaaauauauauauauauauaauuuaaaggaaaaauaggug

SEQ ID NO: 755593 - RNA, 64 nt, hsa
gugaauuuuagucauuaacuucaaaauauauauauauauauaauuuaaaggaaaaauaggugcc

SEQ ID NO: 755594 - RNA, 64 nt, hsa
aauuggcggguaaaaaucacaaaaugcagucgaauauauauaugaaaacuugcauuaggugaua

SEQ ID NO: 755595 - RNA, 64 nt, hsa
ugggcgacagagcaagaccaccaucuccaaaaauuauauauauaaaaauaauuaauauuauaga

SEQ ID NO: 755596 - RNA, 64 nt, hsa
ggcgacagagcaagaccaccaucuccaaaaauuauauauauaaaaauaauuaauauuauagaag

SEQ ID NO: 755597 - RNA, 64 nt, hsa
gucaaucaagacaaaugaaauauauauguauguguauauauauacauguauguaugaaauauau

SEQ ID NO: 755598 - RNA, 64 nt, hsa
caaucaagacaaaugaaauauauauguauguguauauauauacauguauguaugaaauauauau

SEQ ID NO: 755599 - RNA, 64 nt, hsa
auguauguguauauauauacauguauguaugaaauauauauaugugcguguguguguguauaua

SEQ ID NO: 755600 - RNA, 64 nt, hsa
auguaugaaauauauauaugugcguguguguguguauauauauauauauauauauauauuucua

SEQ ID NO: 755601 - RNA, 64 nt, hsa
guaugaaauauauauaugugcguguguguguguauauauauauauauauauauauauuucuaug

SEQ ID NO: 755602 - RNA, 64 nt, hsa
augaaauauauauaugugcguguguguguguauauauauauauauauauauauauuucuaugaa

SEQ ID NO: 755603 - RNA, 64 nt, hsa
gaaauauauauaugugcguguguguguguauauauauauauauauauauauauuucuaugaaau

SEQ ID NO: 755604 - RNA, 64 nt, hsa
aauauauauaugugcguguguguguguauauauauauauauauauauauauuucuaugaaauug

SEQ ID NO: 755605 - RNA, 64 nt, hsa
uauauauaugugcguguguguguguauauauauauauauauauauauauuucuaugaaauuguc

SEQ ID NO: 755606 - RNA, 64 nt, hsa
uauauaugugcguguguguguguauauauauauauauauauauauauuucuaugaaauugucca

SEQ ID NO: 755607 - RNA, 64 nt, hsa
uauaugugcguguguguguguauauauauauauauauauauauauuucuaugaaauuguccaga

SEQ ID NO: 755608 - RNA, 64 nt, hsa
uaugugcguguguguguguauauauauauauauauauauauauuucuaugaaauuguccagaug

SEQ ID NO: 755609 - RNA, 64 nt, hsa
uacacuaacauauuuagaagcugaacuuacugcuuauauauauuugauuguaaaaacaaaaaga

SEQ ID NO: 755610 - RNA, 64 nt, hsa
gaaauauauauauauauauauauauauauauauauauauauaaauuaaaaaggaaagaaaacua

SEQ ID NO: 755611 - RNA, 64 nt, hsa
aggaaauauauauauauauauauauauauauauauauauauauaaauuaaaaaggaaagaaaac

SEQ ID NO: 755612 - RNA, 64 nt, hsa
aaaggaaauauauauauauauauauauauauauauauauauauauaaauuaaaaaggaaagaaa

SEQ ID NO: 755613 - RNA, 64 nt, hsa
caaaaggaaauauauauauauauauauauauauauauauauauauauaaauuaaaaaggaaaga

SEQ ID NO: 755614 - RNA, 64 nt, hsa
uucaaaaggaaauauauauauauauauauauauauauauauauauauauaaauuaaaaaggaaa

SEQ ID NO: 755615 - RNA, 64 nt, hsa
uauucaaaaggaaauauauauauauauauauauauauauauauauauauauaaauuaaaaagga

SEQ ID NO: 755616 - RNA, 64 nt, hsa
ucuauucaaaaggaaauauauauauauauauauauauauauauauauauauauaaauuaaaaag

SEQ ID NO: 755617 - RNA, 64 nt, hsa
auucuauucaaaaggaaauauauauauauauauauauauauauauauauauauauaaauuaaaa

SEQ ID NO: 755618 - RNA, 64 nt, hsa
guauucuauucaaaaggaaauauauauauauauauauauauauauauauauauauauaaauuaa

SEQ ID NO: 755619 - RNA, 64 nt, hsa
ucguauucuauucaaaaggaaauauauauauauauauauauauauauauauauauauauaaauu

SEQ ID NO: 755620 - RNA, 64 nt, hsa
guucguauucuauucaaaaggaaauauauauauauauauauauauauauauauauauauauaaa

SEQ ID NO: 755621 - RNA, 64 nt, hsa
auguucguauucuauucaaaaggaaauauauauauauauauauauauauauauauauauauaua

SEQ ID NO: 755622 - RNA, 64 nt, hsa
aaauguucguauucuauucaaaaggaaauauauauauauauauauauauauauauauauauaua

SEQ ID NO: 755623 - RNA, 64 nt, hsa
caaaauguucguauucuauucaaaaggaaauauauauauauauauauauauauauauauauaua

SEQ ID NO: 755624 - RNA, 64 nt, hsa
uucaaaauguucguauucuauucaaaaggaaauauauauauauauauauauauauauauauaua

SEQ ID NO: 755625 - RNA, 64 nt, hsa
acuucaaaauguucguauucuauucaaaaggaaauauauauauauauauauauauauauauaua

SEQ ID NO: 755626 - RNA, 64 nt, hsa
uguguacguguguauauguguauauauauacacauauauauacacauacacaaauauaugcaua

SEQ ID NO: 755627 - RNA, 64 nt, hsa
uuucaaaauauguguguacguguguauauguguauauauauacacauauauauacacauacaca

SEQ ID NO: 755628 - RNA, 64 nt, hsa
uauuucaaaauauguguguacguguguauauguguauauauauacacauauauauacacauaca

SEQ ID NO: 755629 - RNA, 64 nt, hsa
uccaacaacagaugaauggauaaagaaaaugugguauauauacacaauagaauacuaugcagcc

SEQ ID NO: 755630 - RNA, 64 nt, hsa
aaaaaaagguuaagaaguccuaguugacuuuguauauauauaaagaaaucuauuacaauaaaaa

SEQ ID NO: 755631 - RNA, 64 nt, hsa
acaaaaaaagguuaagaaguccuaguugacuuuguauauauauaaagaaaucuauuacaauaaa

SEQ ID NO: 755632 - RNA, 64 nt, hsa
ucagggguucuuaaccuacauuucaugcaaaaaauauauauauuucaauguauuuuuuauuuua

SEQ ID NO: 755633 - RNA, 64 nt, hsa
ugguaaaaacguauguauuuauauauuauauauuuauauauaauauauauuauauauuuagcau

SEQ ID NO: 755634 - RNA, 64 nt, hsa
gaagaaggccagcauuuaugguagaauauauaauuauauauaagguggccacgcuggggcaagu

SEQ ID NO: 755635 - RNA, 64 nt, hsa
uuuucuuguauuucuguuuccauauauauauauauauauauaauuuccaauucaggauauugcc

SEQ ID NO: 755636 - RNA, 64 nt, hsa
uauuuucuuguauuucuguuuccauauauauauauauauauauaauuuccaauucaggauauug

SEQ ID NO: 755637 - RNA, 64 nt, hsa
cauauuuucuuguauuucuguuuccauauauauauauauauauauaauuuccaauucaggauau

SEQ ID NO: 755638 - RNA, 64 nt, hsa
agcauauuuucuuguauuucuguuuccauauauauauauauauauauaauuuccaauucaggau

SEQ ID NO: 755639 - RNA, 64 nt, hsa
caagcauauuuucuuguauuucuguuuccauauauauauauauauauauaauuuccaauucagg

SEQ ID NO: 755640 - RNA, 64 nt, hsa
cccaagcauauuuucuuguauuucuguuuccauauauauauauauauauauaauuuccaauuca

SEQ ID NO: 755641 - RNA, 64 nt, hsa
cccccaagcauauuuucuuguauuucuguuuccauauauauauauauauauauaauuuccaauu

SEQ ID NO: 755642 - RNA, 64 nt, hsa
auuuuuuuaaauguguguuauguacauauauauauauauauaauauauauuaaaaaugaaacaa

SEQ ID NO: 755643 - RNA, 64 nt, hsa
ggauuuuuuuaaauguguguuauguacauauauauauauauauaauauauauuaaaaaugaaac

SEQ ID NO: 755644 - RNA, 64 nt, hsa
ugggauuuuuuuaaauguguguuauguacauauauauauauauauaauauauauuaaaaaugaa

SEQ ID NO: 755645 - RNA, 64 nt, hsa
ggugggauuuuuuuaaauguguguuauguacauauauauauauauauaauauauauuaaaaaug

SEQ ID NO: 755646 - RNA, 64 nt, hsa
guggugggauuuuuuuaaauguguguuauguacauauauauauauauauaauauauauuaaaaa

SEQ ID NO: 755647 - RNA, 64 nt, hsa
aaacaccuuaagcaauauauuuuccuaguagauauauauauacacauacauauauacacauaua

SEQ ID NO: 755648 - RNA, 64 nt, hsa
acaaacaccuuaagcaauauauuuuccuaguagauauauauauacacauacauauauacacaua

SEQ ID NO: 755649 - RNA, 64 nt, hsa
cacuuggguuuuuuaauuaauucuauuuuauauauauauauauguuucuuuuccugugaaaagc

SEQ ID NO: 755650 - RNA, 64 nt, hsa
gacacuuggguuuuuuaauuaauucuauuuuauauauauauauauguuucuuuuccugugaaaa

SEQ ID NO: 755651 - RNA, 64 nt, hsa
augacacuuggguuuuuuaauuaauucuauuuuauauauauauauauguuucuuuuccugugaa

SEQ ID NO: 755652 - RNA, 64 nt, hsa
auaugacacuuggguuuuuuaauuaauucuauuuuauauauauauauauguuucuuuuccugug

SEQ ID NO: 755653 - RNA, 64 nt, hsa
guauuugaauauuuuguaaugcacugcuauuuauuauauauaucaacaguaguucaaggugcca

SEQ ID NO: 755654 - RNA, 64 nt, hsa
uuaguuaugugcaagcuuuguauauucuuauauuuauauauaaauauaaaaauuuguuaaaggc

SEQ ID NO: 755655 - RNA, 64 nt, hsa
uuuauauauauauauauauauauauacauacauauauauauaucauauagcuuaagcugauuua

SEQ ID NO: 755656 - RNA, 64 nt, hsa
auuuuauauauauauauauauauauauacauacauauauauauaucauauagcuuaagcugauu

SEQ ID NO: 755657 - RNA, 64 nt, hsa
aaagaucuagugcgauuuuauauauauauauauauauauauacauacauauauauauaucauau

SEQ ID NO: 755658 - RNA, 64 nt, hsa
aaaaagaucuagugcgauuuuauauauauauauauauauauauacauacauauauauauaucau

SEQ ID NO: 755659 - RNA, 64 nt, hsa
aaaaaaagaucuagugcgauuuuauauauauauauauauauauauacauacauauauauauauc

SEQ ID NO: 755660 - RNA, 64 nt, hsa
gcaaaaaaagaucuagugcgauuuuauauauauauauauauauauauacauacauauauauaua

SEQ ID NO: 755661 - RNA, 64 nt, hsa
uagcaaaaaaagaucuagugcgauuuuauauauauauauauauauauauacauacauauauaua

SEQ ID NO: 755662 - RNA, 64 nt, hsa
gauagcaaaaaaagaucuagugcgauuuuauauauauauauauauauauauacauacauauaua

SEQ ID NO: 755663 - RNA, 64 nt, hsa
aggauagcaaaaaaagaucuagugcgauuuuauauauauauauauauauauauacauacauaua

SEQ ID NO: 755664 - RNA, 64 nt, hsa
agaggauagcaaaaaaagaucuagugcgauuuuauauauauauauauauauauauacauacaua

SEQ ID NO: 755665 - RNA, 64 nt, hsa
aaagaggauagcaaaaaaagaucuagugcgauuuuauauauauauauauauauauauacauaca

SEQ ID NO: 755666 - RNA, 64 nt, hsa
aagaguaaaugcccuacauggugugaugcugcauuauauauaaaacugugugcauauauuaaau

SEQ ID NO: 755667 - RNA, 64 nt, hsa
ugugaucauuugugauguuacuuguaaaaaaaaguauauauacauaucuuuugaaguguuaaaa

SEQ ID NO: 755668 - RNA, 64 nt, hsa
auccuuguuuugaaaaccuaaaagacaggcucuguauauauauauacuuaagaauaugcugacu

SEQ ID NO: 755669 - RNA, 64 nt, hsa
ccuuguuuugaaaaccuaaaagacaggcucuguauauauauauacuuaagaauaugcugacuuc

SEQ ID NO: 755670 - RNA, 64 nt, hsa
uuguuuugaaaaccuaaaagacaggcucuguauauauauauacuuaagaauaugcugacuucac

SEQ ID NO: 755671 - RNA, 64 nt, hsa
accaugagauagcauuagcugcccaggaugcugcuauauauauauauauauauauauaugugug

SEQ ID NO: 755672 - RNA, 64 nt, hsa
caugagauagcauuagcugcccaggaugcugcuauauauauauauauauauauauaugugugug

SEQ ID NO: 755673 - RNA, 64 nt, hsa
ugagauagcauuagcugcccaggaugcugcuauauauauauauauauauauauaugugugugug

SEQ ID NO: 755674 - RNA, 64 nt, hsa
agauagcauuagcugcccaggaugcugcuauauauauauauauauauauauaugugugugugug

SEQ ID NO: 755675 - RNA, 64 nt, hsa
auagcauuagcugcccaggaugcugcuauauauauauauauauauauauaugugugugugugug

SEQ ID NO: 755676 - RNA, 64 nt, hsa
agcauuagcugcccaggaugcugcuauauauauauauauauauauauaugugugugugugugug

SEQ ID NO: 755677 - RNA, 64 nt, hsa
cauuagcugcccaggaugcugcuauauauauauauauauauauauaugugugugugugugugug

SEQ ID NO: 755678 - RNA, 64 nt, hsa
uuagcugcccaggaugcugcuauauauauauauauauauauauaugugugugugugugugugug

SEQ ID NO: 755679 - RNA, 64 nt, hsa
agcugcccaggaugcugcuauauauauauauauauauauauaugugugugugugugugugugug

SEQ ID NO: 755680 - RNA, 64 nt, hsa
uauauauauguguguguguguguguguguguguguauauauauauauauauauauauauauaua

SEQ ID NO: 755681 - RNA, 64 nt, hsa
uauauauguguguguguguguguguguguguguauauauauauauauauauauauauauauaua

SEQ ID NO: 755682 - RNA, 64 nt, hsa
uauauguguguguguguguguguguguguguauauauauauauauauauauauauauauauaua

SEQ ID NO: 755683 - RNA, 64 nt, hsa
uauguguguguguguguguguguguguguauauauauauauauauauauauauauauauauaua

SEQ ID NO: 755684 - RNA, 64 nt, hsa
uguguguguguguguguguguguguguauauauauauauauauauauauauauauauauauaua

SEQ ID NO: 755685 - RNA, 64 nt, hsa
uguguguguguguguguguguguguauauauauauauauauauauauauauauauauauauaua

SEQ ID NO: 755686 - RNA, 64 nt, hsa
uguguguguguguguguguguguauauauauauauauauauauauauauauauauauauauaug

SEQ ID NO: 755687 - RNA, 64 nt, hsa
uguguguguguguguguguguauauauauauauauauauauauauauauauauauauauaugug

SEQ ID NO: 755688 - RNA, 64 nt, hsa
uguguguguguguguguguauauauauauauauauauauauauauauauauauauauaugugug

SEQ ID NO: 755689 - RNA, 64 nt, hsa
uguguguguguguguguauauauauauauauauauauauauauauauauauauauaugugugug

SEQ ID NO: 755690 - RNA, 64 nt, hsa
uguguguguguguguauauauauauauauauauauauauauauauauauauauaugugugugua

SEQ ID NO: 755691 - RNA, 64 nt, hsa
uguguguguguguauauauauauauauauauauauauauauauauauauauauguguguguaua

SEQ ID NO: 755692 - RNA, 64 nt, hsa
uguguguguguauauauauauauauauauauauauauauauauauauauauguguguguauaua

SEQ ID NO: 755693 - RNA, 64 nt, hsa
uguguguguauauauauauauauauauauauauauauauauauauauauguguguguauauaua

SEQ ID NO: 755694 - RNA, 64 nt, hsa
uguguguauauauauauauauauauauauauauauauauauauauauguguguguauauauaua

SEQ ID NO: 755695 - RNA, 64 nt, hsa
uguguauauauauauauauauauauauauauauauauauauauauguguguguauauauauaua

SEQ ID NO: 755696 - RNA, 64 nt, hsa
uguauauauauauauauauauauauauauauauauauauauauguguguguauauauauauaua

SEQ ID NO: 755697 - RNA, 64 nt, hsa
uauauauauauauauauauauauauauguguguguauauauauauauauguguauauauauaug

SEQ ID NO: 755698 - RNA, 64 nt, hsa
uauauauauauauauauauauauauguguguguauauauauauauauguguauauauauaugua

SEQ ID NO: 755699 - RNA, 64 nt, hsa
uauauauauauauauauauauauguguguguauauauauauauauguguauauauauauguaua

SEQ ID NO: 755700 - RNA, 64 nt, hsa
uauauauauauauauauauauguguguguauauauauauauauguguauauauauauguauaua

SEQ ID NO: 755701 - RNA, 64 nt, hsa
uauauauauguguguguauauauauauauauguguauauauauauguauauacauauauguaua

SEQ ID NO: 755702 - RNA, 64 nt, hsa
uauauauguguguguauauauauauauauguguauauauauauguauauacauauauguauaua

SEQ ID NO: 755703 - RNA, 64 nt, hsa
uauauguguauauauauauguauauacauauauguauauauaugcacauauauauauguauuua

SEQ ID NO: 755704 - RNA, 64 nt, hsa
uauauguauauacauauauguauauauaugcacauauauauauguauuuaaaaaaaucaaaaca

SEQ ID NO: 755705 - RNA, 64 nt, hsa
gacuuggugugaagacucacuucucagcugaaauuauauauauacacauauauauauuuuacau

SEQ ID NO: 755706 - RNA, 64 nt, hsa
cuuggugugaagacucacuucucagcugaaauuauauauauacacauauauauauuuuacaucu

SEQ ID NO: 755707 - RNA, 64 nt, hsa
acucacuucucagcugaaauuauauauauacacauauauauauuuuacaucugggaucaugaua

SEQ ID NO: 755708 - RNA, 64 nt, hsa
gggauuuaugucuacauauuuguguguguguguguauauauauguaauaugcauacacagaugc

SEQ ID NO: 755709 - RNA, 64 nt, hsa
auauauguaauaugcauacacagaugcauauguguauauauaaugaaauuuauguugcugguau

SEQ ID NO: 755710 - RNA, 64 nt, hsa
aaaaauauucucucacagauuucauuccuguuuuuauauauauauuuuuuguugucguuuuaac

SEQ ID NO: 755711 - RNA, 64 nt, hsa
aaauauucucucacagauuucauuccuguuuuuauauauauauuuuuuguugucguuuuaacau

SEQ ID NO: 755712 - RNA, 64 nt, hsa
aguuuauacccugggugcuggggucgcacuguguuauauauauauauauauauauauaaugugu

SEQ ID NO: 755713 - RNA, 64 nt, hsa
uuuauacccugggugcuggggucgcacuguguuauauauauauauauauauauauaauguguau

SEQ ID NO: 755714 - RNA, 64 nt, hsa
uauacccugggugcuggggucgcacuguguuauauauauauauauauauauauaauguguauau

SEQ ID NO: 755715 - RNA, 64 nt, hsa
uacccugggugcuggggucgcacuguguuauauauauauauauauauauauaauguguauauau

SEQ ID NO: 755716 - RNA, 64 nt, hsa
cccugggugcuggggucgcacuguguuauauauauauauauauauauauaauguguauauauau

SEQ ID NO: 755717 - RNA, 64 nt, hsa
cugggugcuggggucgcacuguguuauauauauauauauauauauauaauguguauauauauau

SEQ ID NO: 755718 - RNA, 64 nt, hsa
gggugcuggggucgcacuguguuauauauauauauauauauauauaauguguauauauauauau

SEQ ID NO: 755719 - RNA, 64 nt, hsa
gugcuggggucgcacuguguuauauauauauauauauauauauaauguguauauauauauauuc

SEQ ID NO: 755720 - RNA, 64 nt, hsa
gcuggggucgcacuguguuauauauauauauauauauauauaauguguauauauauauauucua

SEQ ID NO: 755721 - RNA, 64 nt, hsa
uguguuauauauauauauauauauauauaauguguauauauauauauucuauuuuuuuugguug

SEQ ID NO: 755722 - RNA, 64 nt, hsa
uguuauauauauauauauauauauauaauguguauauauauauauucuauuuuuuuugguuggg

SEQ ID NO: 755723 - RNA, 64 nt, hsa
uuauauauauauauauauauauauaauguguauauauauauauucuauuuuuuuugguuggguu

SEQ ID NO: 755724 - RNA, 64 nt, hsa
ucuucuaaggggggagggaaaggggggagauuuuuauauauauauacauauauauauaucaagu

SEQ ID NO: 755725 - RNA, 64 nt, hsa
uucuaaggggggagggaaaggggggagauuuuuauauauauauacauauauauauaucaaguuu

SEQ ID NO: 755726 - RNA, 64 nt, hsa
cuaaggggggagggaaaggggggagauuuuuauauauauauacauauauauauaucaaguuuua

SEQ ID NO: 755727 - RNA, 64 nt, hsa
agggaaaggggggagauuuuuauauauauauacauauauauauaucaaguuuuaaauuauugau

SEQ ID NO: 755728 - RNA, 64 nt, hsa
ggaaaggggggagauuuuuauauauauauacauauauauauaucaaguuuuaaauuauugauag

SEQ ID NO: 755729 - RNA, 64 nt, hsa
cuugaguguguucgcguguguggguggauauaaauauauauaaauauauauaaauaaauauaua

SEQ ID NO: 755730 - RNA, 64 nt, hsa
uucgcguguguggguggauauaaauauauauaaauauauauaaauaaauauauauauccucugu

SEQ ID NO: 755731 - RNA, 64 nt, hsa
uggauauaaauauauauaaauauauauaaauaaauauauauauccucuguauaaaaugagguuu

SEQ ID NO: 755732 - RNA, 64 nt, hsa
gaagaauaaauguauaaauguuauuuuugauguuuauauauaaacucuauauccuaauuuacua

SEQ ID NO: 755733 - RNA, 64 nt, hsa
aguguuugauucagagaugucugcucuuuuaaauuauauauaaggaaaaaaaauagccugccuu

SEQ ID NO: 755734 - RNA, 64 nt, hsa
ccuuuccccuucuggucccugcgcuuugguauaauauauauacuucuccauacacagaccucug

SEQ ID NO: 755735 - RNA, 64 nt, hsa
acaaagauuggcucugaugguuuuuauguauaaauauauauauauaauaaaauauaauacauuu

SEQ ID NO: 755736 - RNA, 64 nt, hsa
aaagauuggcucugaugguuuuuauguauaaauauauauauauaauaaaauauaauacauuuuu

SEQ ID NO: 755737 - RNA, 64 nt, hsa
agauuggcucugaugguuuuuauguauaaauauauauauauaauaaaauauaauacauuuuuau

SEQ ID NO: 755738 - RNA, 64 nt, hsa
uuuguaaugaccaaaggaaugaggcugacauagguauauauauauauuuuuuuccuuuauuuga

SEQ ID NO: 755739 - RNA, 64 nt, hsa
uguaaugaccaaaggaaugaggcugacauagguauauauauauauuuuuuuccuuuauuugaua

SEQ ID NO: 755740 - RNA, 64 nt, hsa
uaaugaccaaaggaaugaggcugacauagguauauauauauauuuuuuuccuuuauuugauaaa

SEQ ID NO: 755741 - RNA, 64 nt, hsa
auagggguuuuaucgggcgugaauguaaauaaauuauauauauauauugcuaaccugagugcua

SEQ ID NO: 755742 - RNA, 64 nt, hsa
agggguuuuaucgggcgugaauguaaauaaauuauauauauauauugcuaaccugagugcuacu

SEQ ID NO: 755743 - RNA, 64 nt, hsa
ggguuuuaucgggcgugaauguaaauaaauuauauauauauauugcuaaccugagugcuacuuc

SEQ ID NO: 755744 - RNA, 64 nt, hsa
agggcauggaaguuuuuuuaaauaauuaaaaaaauauauauauaauuuugagaauugagcauuu

SEQ ID NO: 755745 - RNA, 64 nt, hsa
ggcauggaaguuuuuuuaaauaauuaaaaaaauauauauauaauuuugagaauugagcauuuaa

SEQ ID NO: 755746 - RNA, 64 nt, hsa
uauauaguacauguauauauauaguacauguguauauauauauuacacacuacuguuguuuucu

SEQ ID NO: 755747 - RNA, 64 nt, hsa
uauauauaguacauguauauauauaguacauguguauauauauauuacacacuacuguuguuuu

SEQ ID NO: 755748 - RNA, 64 nt, hsa
uguaauauauauauguauauauauaguacauguauauauauaguacauguguauauauauauua

SEQ ID NO: 755749 - RNA, 64 nt, hsa
uguguaauauauauauguauauauauaguacauguauauauauaguacauguguauauauauau

SEQ ID NO: 755750 - RNA, 64 nt, hsa
auguguguguguguguguguaauauauauauguauauauauaguacauguauauauauaguaca

SEQ ID NO: 755751 - RNA, 64 nt, hsa
auauguguguguguguguguguaauauauauauguauauauauaguacauguauauauauagua

SEQ ID NO: 755752 - RNA, 64 nt, hsa
auauauauauauauguguguguguguguguguaauauauauauguauauauauaguacauguau

SEQ ID NO: 755753 - RNA, 64 nt, hsa
acuccuuuaccuagggaaggaaaaaaaaaauauauauauauauguguguguguguguguguaau

SEQ ID NO: 755754 - RNA, 64 nt, hsa
ucacuccuuuaccuagggaaggaaaaaaaaaauauauauauauaugugugugugugugugugua

SEQ ID NO: 755755 - RNA, 64 nt, hsa
uaucacuccuuuaccuagggaaggaaaaaaaaaauauauauauauaugugugugugugugugug

SEQ ID NO: 755756 - RNA, 64 nt, hsa
gucuaaaugauauauauaugauauauaugugauauauauauaucauauauaugauauauauaua

SEQ ID NO: 755757 - RNA, 64 nt, hsa
cugucuaaaugauauauauaugauauauaugugauauauauauaucauauauaugauauauaua

SEQ ID NO: 755758 - RNA, 64 nt, hsa
ccuggucaccuucuuggaucugcugucuaaaugauauauauaugauauauaugugauauauaua

SEQ ID NO: 755759 - RNA, 64 nt, hsa
agacacaauuauauauuguugauauauauauauauauauauacacacacacacacacacuauga

SEQ ID NO: 755760 - RNA, 64 nt, hsa
ugagacacaauuauauauuguugauauauauauauauauauauacacacacacacacacacuau

SEQ ID NO: 755761 - RNA, 64 nt, hsa
auugagacacaauuauauauuguugauauauauauauauauauauacacacacacacacacacu

SEQ ID NO: 755762 - RNA, 64 nt, hsa
uaauugagacacaauuauauauuguugauauauauauauauauauauacacacacacacacaca

SEQ ID NO: 755763 - RNA, 64 nt, hsa
ucuaauugagacacaauuauauauuguugauauauauauauauauauauacacacacacacaca

SEQ ID NO: 755764 - RNA, 64 nt, hsa
ccucuaauugagacacaauuauauauuguugauauauauauauauauauauacacacacacaca

SEQ ID NO: 755765 - RNA, 64 nt, hsa
caccucuaauugagacacaauuauauauuguugauauauauauauauauauauacacacacaca

SEQ ID NO: 755766 - RNA, 64 nt, hsa
uaaacuuuauucccuauaacuuaaaauguguauauauauauaauaguuuauuauguacaguuaa

SEQ ID NO: 755767 - RNA, 64 nt, hsa
aauaaacuuuauucccuauaacuuaaaauguguauauauauauaauaguuuauuauguacaguu

SEQ ID NO: 755768 - RNA, 64 nt, hsa
aaaauaaacuuuauucccuauaacuuaaaauguguauauauauauaauaguuuauuauguacag

SEQ ID NO: 755769 - RNA, 64 nt, hsa
aaagaugguaauuuaggaugcauauauauauauauauauauaaaggaaucuuggauugggaauu

SEQ ID NO: 755770 - RNA, 64 nt, hsa
caaaagaugguaauuuaggaugcauauauauauauauauauauaaaggaaucuuggauugggaa

SEQ ID NO: 755771 - RNA, 64 nt, hsa
cucaaaagaugguaauuuaggaugcauauauauauauauauauauaaaggaaucuuggauuggg

SEQ ID NO: 755772 - RNA, 64 nt, hsa
aucucaaaagaugguaauuuaggaugcauauauauauauauauauauaaaggaaucuuggauug

SEQ ID NO: 755773 - RNA, 64 nt, hsa
acaucucaaaagaugguaauuuaggaugcauauauauauauauauauauaaaggaaucuuggau

SEQ ID NO: 755774 - RNA, 64 nt, hsa
auacaucucaaaagaugguaauuuaggaugcauauauauauauauauauauaaaggaaucuugg

SEQ ID NO: 755775 - RNA, 64 nt, hsa
uuauacaucucaaaagaugguaauuuaggaugcauauauauauauauauauauaaaggaaucuu

SEQ ID NO: 755776 - RNA, 64 nt, hsa
gcaaauaauuauauauaaauauauuuaaaaaugcuauauauaguauaugccauaguuuagaaag

SEQ ID NO: 755777 - RNA, 64 nt, hsa
ugcaaauuccuucuaaauuucaugugcaaauaauuauauauaaauauauuuaaaaaugcuauau

SEQ ID NO: 755778 - RNA, 64 nt, hsa
uguuguaaguuucuuugcuuacuuuuacugucuauauauauagggagcacuuuaaacuuaaugc

SEQ ID NO: 755779 - RNA, 64 nt, hsa
uguguuguaaguuucuuugcuuacuuuuacugucuauauauauagggagcacuuuaaacuuaau

SEQ ID NO: 755780 - RNA, 64 nt, hsa
uauacguauacauaucuguauauauacauauauauauauauaaauauaaauauauucuuuacuu

SEQ ID NO: 755781 - RNA, 64 nt, hsa
uauauacguauacauaucuguauauauacauauauauauauauaaauauaaauauauucuuuac

SEQ ID NO: 755782 - RNA, 64 nt, hsa
uauauauacguauacauaucuguauauauacauauauauauauauaaauauaaauauauucuuu

SEQ ID NO: 755783 - RNA, 64 nt, hsa
uauauauauacguauacauaucuguauauauacauauauauauauauaaauauaaauauauucu

SEQ ID NO: 755784 - RNA, 64 nt, hsa
uucuguuuuauauauauauacguauacauaucuguauauauacauauauauauauauaaauaua

SEQ ID NO: 755785 - RNA, 64 nt, hsa
acaaauguugcuguaauuaaacuucuguuuuauauauauauacguauacauaucuguauauaua

SEQ ID NO: 755786 - RNA, 64 nt, hsa
uaacaaauguugcuguaauuaaacuucuguuuuauauauauauacguauacauaucuguauaua

SEQ ID NO: 755787 - RNA, 64 nt, hsa
aguaacaaauguugcuguaauuaaacuucuguuuuauauauauauacguauacauaucuguaua

SEQ ID NO: 755788 - RNA, 64 nt, hsa
uuuuuuauuacuauuucaaacacacacacauauauauauauauuaaacuuagaugauaaucaaa

SEQ ID NO: 755789 - RNA, 64 nt, hsa
ccuuuuuuauuacuauuucaaacacacacacauauauauauauauuaaacuuagaugauaauca

SEQ ID NO: 755790 - RNA, 64 nt, hsa
uuccuuuuuuauuacuauuucaaacacacacacauauauauauauauuaaacuuagaugauaau

SEQ ID NO: 755791 - RNA, 64 nt, hsa
gauuuuuuuuaauacauuaagagaaagagaaauauauauauauccacccccagcccaaccgagg

SEQ ID NO: 755792 - RNA, 64 nt, hsa
uugauuuuuuuuaauacauuaagagaaagagaaauauauauauauccacccccagcccaaccga

SEQ ID NO: 755793 - RNA, 64 nt, hsa
guuuguagcauuuaacauaacuaguauguuguauuauauauauguguauacugauugaaauuuu

SEQ ID NO: 755794 - RNA, 64 nt, hsa
cagcgccuguguucuguguuagaaagguuuuauauauauauaaaauuacauauauauguagaaa

SEQ ID NO: 755795 - RNA, 64 nt, hsa
cccagcgccuguguucuguguuagaaagguuuuauauauauauaaaauuacauauauauguaga

SEQ ID NO: 755796 - RNA, 64 nt, hsa
ggcccagcgccuguguucuguguuagaaagguuuuauauauauauaaaauuacauauauaugua

SEQ ID NO: 755797 - RNA, 64 nt, hsa
cccugagagaaguagcacucagguuagcaauauauauauauaauuuauuuacauucacgcccga

SEQ ID NO: 755798 - RNA, 64 nt, hsa
uucccugagagaaguagcacucagguuagcaauauauauauauaauuuauuuacauucacgccc

SEQ ID NO: 755799 - RNA, 64 nt, hsa
cuuucccugagagaaguagcacucagguuagcaauauauauauauaauuuauuuacauucacgc

SEQ ID NO: 755800 - RNA, 64 nt, hsa
cugccuaagcacucaccuuccgauuuuacccaaguauauauauaggauagaaaaaaaugcauua

SEQ ID NO: 755801 - RNA, 64 nt, hsa
gccuaagcacucaccuuccgauuuuacccaaguauauauauaggauagaaaaaaaugcauuaua

SEQ ID NO: 755802 - RNA, 64 nt, hsa
augauuguguaauuuaaagguauauaaauacaaauauauauauauaucaguugugauuguauga

SEQ ID NO: 755803 - RNA, 64 nt, hsa
gauuguguaauuuaaagguauauaaauacaaauauauauauauaucaguugugauuguaugacu

SEQ ID NO: 755804 - RNA, 64 nt, hsa
uuguguaauuuaaagguauauaaauacaaauauauauauauaucaguugugauuguaugacugu

SEQ ID NO: 755805 - RNA, 64 nt, hsa
cccaggucugugucugauagcauacacacacacauauauauacacacacacacacacacacaca

SEQ ID NO: 755806 - RNA, 64 nt, hsa
cacacacacacacacacauacauacacacacacauauauauacacacacacacacacacacaca

SEQ ID NO: 755807 - RNA, 64 nt, hsa
uaauaucuauagaaaaguagagugagggugaauuuauauauauauuuuguuuugccaauaugaa

SEQ ID NO: 755808 - RNA, 64 nt, hsa
auaucuauagaaaaguagagugagggugaauuuauauauauauuuuguuuugccaauaugaaga

SEQ ID NO: 755809 - RNA, 64 nt, hsa
uguguguguguguguguguguguguguguguguguauauauauauauauauuuuuacuuuuauc

SEQ ID NO: 755810 - RNA, 64 nt, hsa
uguguguguguguguguguguguguguguguguauauauauauauauauuuuuacuuuuauccu

SEQ ID NO: 755811 - RNA, 64 nt, hsa
uguguguguguguguguguguguguguguguauauauauauauauauuuuuacuuuuauccucu

SEQ ID NO: 755812 - RNA, 64 nt, hsa
uguguguguguguguguguguguguguguauauauauauauauauuuuuacuuuuauccucuua

SEQ ID NO: 755813 - RNA, 64 nt, hsa
uguguguguguguguguguguguguguauauauauauauauauuuuuacuuuuauccucuuacc

SEQ ID NO: 755814 - RNA, 64 nt, hsa
cuaaguuauaaaugugugugugugcguguguguguauauauauauauauauauauauauauaua

SEQ ID NO: 755815 - RNA, 64 nt, hsa
aaguuauaaaugugugugugugcguguguguguauauauauauauauauauauauauauauaua

SEQ ID NO: 755816 - RNA, 64 nt, hsa
guuauaaaugugugugugugcguguguguguauauauauauauauauauauauauauauauaua

SEQ ID NO: 755817 - RNA, 64 nt, hsa
uauaaaugugugugugugcguguguguguauauauauauauauauauauauauauauauauaua

SEQ ID NO: 755818 - RNA, 64 nt, hsa
uaaaugugugugugugcguguguguguauauauauauauauauauauauauauauauauauaua

SEQ ID NO: 755819 - RNA, 64 nt, hsa
aaugugugugugugcguguguguguauauauauauauauauauauauauauauauauauauaua

SEQ ID NO: 755820 - RNA, 64 nt, hsa
ugugugugugugcguguguguguauauauauauauauauauauauauauauauauauauauaua

SEQ ID NO: 755821 - RNA, 64 nt, hsa
ugugugugugcguguguguguauauauauauauauauauauauauauauauauauauauauaua

SEQ ID NO: 755822 - RNA, 64 nt, hsa
ugugugugcguguguguguauauauauauauauauauauauauauauauauauauauauauaua

SEQ ID NO: 755823 - RNA, 64 nt, hsa
ugugugcguguguguguauauauauauauauauauauauauauauauauauauauauauauaua

SEQ ID NO: 755824 - RNA, 64 nt, hsa
ugugcguguguguguauauauauauauauauauauauauauauauauauauauauauauauaug

SEQ ID NO: 755825 - RNA, 64 nt, hsa
ugcguguguguguauauauauauauauauauauauauauauauauauauauauauauauaugga

SEQ ID NO: 755826 - RNA, 64 nt, hsa
cguguguguguauauauauauauauauauauauauauauauauauauauauauauauauggaau

SEQ ID NO: 755827 - RNA, 64 nt, hsa
uguguguguauauauauauauauauauauauauauauauauauauauauauauauauggaauug

SEQ ID NO: 755828 - RNA, 64 nt, hsa
uguguguauauauauauauauauauauauauauauauauauauauauauauauauggaauugga

SEQ ID NO: 755829 - RNA, 64 nt, hsa
uguguauauauauauauauauauauauauauauauauauauauauauauauauggaauuggaac

SEQ ID NO: 755830 - RNA, 64 nt, hsa
uguauauauauauauauauauauauauauauauauauauauauauauauauggaauuggaacuu

SEQ ID NO: 755831 - RNA, 64 nt, hsa
uauauauauauauauauauauauauauauauauauauauauauauauauggaauuggaacuuau

SEQ ID NO: 755832 - RNA, 64 nt, hsa
uauauauauauauauauauauauauauauauauauauauauauauauggaauuggaacuuauuu

SEQ ID NO: 755833 - RNA, 64 nt, hsa
uauauauauauauauauauauauauauauauauauauauauauauggaauuggaacuuauuuua

SEQ ID NO: 755834 - RNA, 64 nt, hsa
uauauauauauauauauauauauauauauauauauauauauauggaauuggaacuuauuuuaaa

SEQ ID NO: 755835 - RNA, 64 nt, hsa
cuuuaugucguguaguuuguauaauguguuuaaauauauauauauaugauggcuuuggaagaaa

SEQ ID NO: 755836 - RNA, 64 nt, hsa
uuaugucguguaguuuguauaauguguuuaaauauauauauauaugauggcuuuggaagaaaau

SEQ ID NO: 755837 - RNA, 64 nt, hsa
augucguguaguuuguauaauguguuuaaauauauauauauaugauggcuuuggaagaaaauau

SEQ ID NO: 755838 - RNA, 64 nt, hsa
uuauacuuuuuauaauguuuacguuuguccugaauauauauauauauauauauauauauauaua

SEQ ID NO: 755839 - RNA, 64 nt, hsa
auacuuuuuauaauguuuacguuuguccugaauauauauauauauauauauauauauauauaua

SEQ ID NO: 755840 - RNA, 64 nt, hsa
acuuuuuauaauguuuacguuuguccugaauauauauauauauauauauauauauauauauaug

SEQ ID NO: 755841 - RNA, 64 nt, hsa
uuuuuauaauguuuacguuuguccugaauauauauauauauauauauauauauauauauauggu

SEQ ID NO: 755842 - RNA, 64 nt, hsa
uuuauaauguuuacguuuguccugaauauauauauauauauauauauauauauauauaugguau

SEQ ID NO: 755843 - RNA, 64 nt, hsa
uauaauguuuacguuuguccugaauauauauauauauauauauauauauauauauaugguauag

SEQ ID NO: 755844 - RNA, 64 nt, hsa
uaauguuuacguuuguccugaauauauauauauauauauauauauauauauauaugguauagga

SEQ ID NO: 755845 - RNA, 64 nt, hsa
auguuuacguuuguccugaauauauauauauauauauauauauauauauauaugguauaggaga

SEQ ID NO: 755846 - RNA, 64 nt, hsa
guuuacguuuguccugaauauauauauauauauauauauauauauauauaugguauaggagaua

SEQ ID NO: 755847 - RNA, 64 nt, hsa
uuacguuuguccugaauauauauauauauauauauauauauauauauaugguauaggagauaag

SEQ ID NO: 755848 - RNA, 64 nt, hsa
acguuuguccugaauauauauauauauauauauauauauauauauaugguauaggagauaagcu

SEQ ID NO: 755849 - RNA, 64 nt, hsa
guuuguccugaauauauauauauauauauauauauauauauauaugguauaggagauaagcuau

SEQ ID NO: 755850 - RNA, 64 nt, hsa
uuguccugaauauauauauauauauauauauauauauauauaugguauaggagauaagcuauuu

SEQ ID NO: 755851 - RNA, 64 nt, hsa
guuggcucauacugauuauggugccuaagagagcuauauauauacacauguaaaguccauuguu

SEQ ID NO: 755852 - RNA, 64 nt, hsa
uggcucauacugauuauggugccuaagagagcuauauauauacacauguaaaguccauuguuuu

SEQ ID NO: 755853 - RNA, 64 nt, hsa
cugaaaucucagggcaugaacaaggcaaaggccauauauauauauauauauauaucuguauaca

SEQ ID NO: 755854 - RNA, 64 nt, hsa
gaaaucucagggcaugaacaaggcaaaggccauauauauauauauauauauaucuguauacaua

SEQ ID NO: 755855 - RNA, 64 nt, hsa
aaucucagggcaugaacaaggcaaaggccauauauauauauauauauauaucuguauacauauu

SEQ ID NO: 755856 - RNA, 64 nt, hsa
ucucagggcaugaacaaggcaaaggccauauauauauauauauauauaucuguauacauauuau

SEQ ID NO: 755857 - RNA, 64 nt, hsa
ucagggcaugaacaaggcaaaggccauauauauauauauauauauaucuguauacauauuauau

SEQ ID NO: 755858 - RNA, 64 nt, hsa
agggcaugaacaaggcaaaggccauauauauauauauauauauaucuguauacauauuauauau

SEQ ID NO: 755859 - RNA, 64 nt, hsa
ggcaugaacaaggcaaaggccauauauauauauauauauauaucuguauacauauuauauauac

SEQ ID NO: 755860 - RNA, 64 nt, hsa
auauauauauauauauauauaucuguauacauauuauauauacuuauuuacaccugugucuaua

SEQ ID NO: 755861 - RNA, 64 nt, hsa
auuuauaaaucuauuuauaccacuauaucauauguauauauauuuauaaccacuuaaauuguga

SEQ ID NO: 755862 - RNA, 64 nt, hsa
uuuggcagaacaauugcaauugcacuggguauauuauauauauauauguaugcauauauaucau

SEQ ID NO: 755863 - RNA, 64 nt, hsa
uggcagaacaauugcaauugcacuggguauauuauauauauauauguaugcauauauaucauau

SEQ ID NO: 755864 - RNA, 64 nt, hsa
gcagaacaauugcaauugcacuggguauauuauauauauauauguaugcauauauaucauauuu

SEQ ID NO: 755865 - RNA, 64 nt, hsa
ugacuuguuucaaugguuacuuguauaaggauuuuauauauaugauacuauagauaaaauccua

SEQ ID NO: 755866 - RNA, 64 nt, hsa
ucuuuuuaauaaaucuauccugaaagcuauauaauauauauaauuuauaucaaugaauuuacaa

SEQ ID NO: 755867 - RNA, 64 nt, hsa
ugacuaugcacuaguauuucagacuuuuuaauuuuauauauauauacauuuuuuuuccuucugc

SEQ ID NO: 755868 - RNA, 64 nt, hsa
acuaugcacuaguauuucagacuuuuuaauuuuauauauauauacauuuuuuuuccuucugcaa

SEQ ID NO: 755869 - RNA, 64 nt, hsa
uaugcacuaguauuucagacuuuuuaauuuuauauauauauacauuuuuuuuccuucugcaaua

SEQ ID NO: 755870 - RNA, 64 nt, hsa
uuuagauucaucaacagaccaguuuuugugggcauauauauauacacgugcaaauaucagaauu

SEQ ID NO: 755871 - RNA, 64 nt, hsa
uagauucaucaacagaccaguuuuugugggcauauauauauacacgugcaaauaucagaauugu

SEQ ID NO: 755872 - RNA, 64 nt, hsa
cugacuaaaaaucaauauagauauuuuauauacauauauauauauaaaaauacaaaauucagug

SEQ ID NO: 755873 - RNA, 64 nt, hsa
gacuaaaaaucaauauagauauuuuauauacauauauauauauaaaaauacaaaauucagugua

SEQ ID NO: 755874 - RNA, 64 nt, hsa
cuaaaaaucaauauagauauuuuauauacauauauauauauaaaaauacaaaauucaguguacu

SEQ ID NO: 755875 - RNA, 64 nt, hsa
acauaauguccucuuuugcacaauugugcauagauauauauaugcccacacacacugggccaug

SEQ ID NO: 755876 - RNA, 64 nt, hsa
cuaacugcaauuagaaauugucuuuugaauauacuauauauauuuuuuauguuccaauaauguu

SEQ ID NO: 755877 - RNA, 64 nt, hsa
caauaguauuaucgucuacuguuuguuguaaauauauauauauuauuuucuuuuuggucugagu

SEQ ID NO: 755878 - RNA, 64 nt, hsa
cacaauaguauuaucgucuacuguuuguuguaaauauauauauauuauuuucuuuuuggucuga

SEQ ID NO: 755879 - RNA, 64 nt, hsa
acaccagacaaaucgauaacaacuuauauauauauauauauaucuguaaaaauguauuuuguua

SEQ ID NO: 755880 - RNA, 64 nt, hsa
aaacaccagacaaaucgauaacaacuuauauauauauauauauaucuguaaaaauguauuuugu

SEQ ID NO: 755881 - RNA, 64 nt, hsa
uaaaacaccagacaaaucgauaacaacuuauauauauauauauauaucuguaaaaauguauuuu

SEQ ID NO: 755882 - RNA, 64 nt, hsa
cuuaaaacaccagacaaaucgauaacaacuuauauauauauauauauaucuguaaaaauguauu

SEQ ID NO: 755883 - RNA, 64 nt, hsa
cccuuaaaacaccagacaaaucgauaacaacuuauauauauauauauauaucuguaaaaaugua

SEQ ID NO: 755884 - RNA, 64 nt, hsa
uccccuuaaaacaccagacaaaucgauaacaacuuauauauauauauauauaucuguaaaaaug

SEQ ID NO: 755885 - RNA, 64 nt, hsa
gguuucucugugcauauauauauauauacauauguauauauauuuaaauacacauauauauugu

SEQ ID NO: 755886 - RNA, 64 nt, hsa
gauuuguuggcuaagguuucucugugcauauauauauauauacauauguauauauauuuaaaua

SEQ ID NO: 755887 - RNA, 64 nt, hsa
gggauuuguuggcuaagguuucucugugcauauauauauauauacauauguauauauauuuaaa

SEQ ID NO: 755888 - RNA, 64 nt, hsa
cagggauuuguuggcuaagguuucucugugcauauauauauauauacauauguauauauauuua

SEQ ID NO: 755889 - RNA, 64 nt, hsa
cucagggauuuguuggcuaagguuucucugugcauauauauauauauacauauguauauauauu

SEQ ID NO: 755890 - RNA, 64 nt, hsa
guauucaguacugauugcauacaagaugcauguuuauauauauggaaggaauauaguuucauuu

SEQ ID NO: 755891 - RNA, 64 nt, hsa
uaguuuaaaugucucauuguuuuauugacacaucuauauauacauuugugaagcaagaaacaau

SEQ ID NO: 755892 - RNA, 64 nt, hsa
uauauaauauauauauaaaauauauauauauauauauauauauccauaugcaaaaguccugcau

SEQ ID NO: 755893 - RNA, 64 nt, hsa
uauauauaauauauauauaaaauauauauauauauauauauauauccauaugcaaaaguccugc

SEQ ID NO: 755894 - RNA, 64 nt, hsa
auuauauauaauauauauauaaaauauauauauauauauauauauauccauaugcaaaaguccu

SEQ ID NO: 755895 - RNA, 64 nt, hsa
auauuauauauaauauauauauaaaauauauauauauauauauauauauccauaugcaaaaguc

SEQ ID NO: 755896 - RNA, 64 nt, hsa
acauauuauauauaauauauauauaaaauauauauauauauauauauauauccauaugcaaaag

SEQ ID NO: 755897 - RNA, 64 nt, hsa
guacauauuauauauaauauauauauaaaauauauauauauauauauauauauccauaugcaaa

SEQ ID NO: 755898 - RNA, 64 nt, hsa
cuguacauauuauauauaauauauauauaaaauauauauauauauauauauauauccauaugca

SEQ ID NO: 755899 - RNA, 64 nt, hsa
gacuguacauauuauauauaauauauauauaaaauauauauauauauauauauauauccauaug

SEQ ID NO: 755900 - RNA, 64 nt, hsa
uuuuauagcuagacuguacauauuauauauaauauauauauaaaauauauauauauauauauau

SEQ ID NO: 755901 - RNA, 64 nt, hsa
aguuuuauagcuagacuguacauauuauauauaauauauauauaaaauauauauauauauauau

SEQ ID NO: 755902 - RNA, 64 nt, hsa
acacaucaaaguuuuauagcuagacuguacauauuauauauaauauauauauaaaauauauaua

SEQ ID NO: 755903 - RNA, 64 nt, hsa
cacauacauacauacauauauauauauauauacauauauauacauacacacauacauauaauuu

SEQ ID NO: 755904 - RNA, 64 nt, hsa
cacacacacacacauacauacauacauauauauauauauauacauauauauacauacacacaua

SEQ ID NO: 755905 - RNA, 64 nt, hsa
cacacacacacacacauacauacauacauauauauauauauauacauauauauacauacacaca

SEQ ID NO: 755906 - RNA, 64 nt, hsa
cacacacacacacacacauacauacauacauauauauauauauauacauauauauacauacaca

SEQ ID NO: 755907 - RNA, 64 nt, hsa
cacacacacacacacacacauacauacauacauauauauauauauauacauauauauacauaca

SEQ ID NO: 755908 - RNA, 64 nt, hsa
cacacacacacacacacacacauacauacauacauauauauauauauauacauauauauacaua

SEQ ID NO: 755909 - RNA, 64 nt, hsa
agcuuaauuaccccccauugcaguauuauuguuauauauauaguuaauauguuguacaucacaa

SEQ ID NO: 755910 - RNA, 64 nt, hsa
guagcuuaauuaccccccauugcaguauuauuguuauauauauaguuaauauguuguacaucac

SEQ ID NO: 755911 - RNA, 64 nt, hsa
ucuagccugggcaacagaguaagacaaaaaaauauauauauauugaaaaucaaaggaggcaaaa

SEQ ID NO: 755912 - RNA, 64 nt, hsa
acucuagccugggcaacagaguaagacaaaaaaauauauauauauugaaaaucaaaggaggcaa

SEQ ID NO: 755913 - RNA, 64 nt, hsa
guaaauauuguguguguguguguguguguauauauauauauauguacaguuaucuaaguuaauu

SEQ ID NO: 755914 - RNA, 64 nt, hsa
uuguaaauauuguguguguguguguguguguauauauauauauauguacaguuaucuaaguuaa

SEQ ID NO: 755915 - RNA, 64 nt, hsa
uauuguaaauauuguguguguguguguguguguauauauauauauauguacaguuaucuaaguu

SEQ ID NO: 755916 - RNA, 64 nt, hsa
uauauuguaaauauuguguguguguguguguguguauauauauauauauguacaguuaucuaag

SEQ ID NO: 755917 - RNA, 64 nt, hsa
uuuguuuauauacauauaugcacguaucuauauguauauauaaaugcauuauuacacauacauu

SEQ ID NO: 755918 - RNA, 64 nt, hsa
cauaauauauacauacguguguacuuauuauauguauauauacacguauguauagaugugugaa

SEQ ID NO: 755919 - RNA, 64 nt, hsa
ggaauuuaagaaaauauuacuggaauuaaaaauauauauauauuaaacaagaauuuucuuugcu

SEQ ID NO: 755920 - RNA, 64 nt, hsa
caggaauuuaagaaaauauuacuggaauuaaaaauauauauauauuaaacaagaauuuucuuug

SEQ ID NO: 755921 - RNA, 64 nt, hsa
uauugucauaaccaacauccaaaaugacggcugcuauauauaaguguuugucauauggaauuua

SEQ ID NO: 755922 - RNA, 64 nt, hsa
ccauggugagagcacagcaacucauuuauauauauauauauaggcuuuguugaugaaaaacgac

SEQ ID NO: 755923 - RNA, 64 nt, hsa
cuccauggugagagcacagcaacucauuuauauauauauauauaggcuuuguugaugaaaaacg

SEQ ID NO: 755924 - RNA, 64 nt, hsa
ugcuccauggugagagcacagcaacucauuuauauauauauauauaggcuuuguugaugaaaaa

SEQ ID NO: 755925 - RNA, 64 nt, hsa
acugcuccauggugagagcacagcaacucauuuauauauauauauauaggcuuuguugaugaaa

SEQ ID NO: 755926 - RNA, 64 nt, hsa
acacugcuccauggugagagcacagcaacucauuuauauauauauauauaggcuuuguugauga

SEQ ID NO: 755927 - RNA, 64 nt, hsa
auaaugguuguguacugaaccacuucauauuuguuauauauaauauauauauauauaaucuccu

SEQ ID NO: 755928 - RNA, 64 nt, hsa
guguacugaaccacuucauauuuguuauauauaauauauauauauauaaucuccuuaagacuca

SEQ ID NO: 755929 - RNA, 64 nt, hsa
guacugaaccacuucauauuuguuauauauaauauauauauauauaaucuccuuaagacucagc

SEQ ID NO: 755930 - RNA, 64 nt, hsa
acugaaccacuucauauuuguuauauauaauauauauauauauaaucuccuuaagacucagccu

SEQ ID NO: 755931 - RNA, 64 nt, hsa
ugaaccacuucauauuuguuauauauaauauauauauauauaaucuccuuaagacucagccucc

SEQ ID NO: 755932 - RNA, 64 nt, hsa
agaugaagcucaauaauuguucacauuguucuuuuauauauauuuauauauauauauaaaaauu

SEQ ID NO: 755933 - RNA, 64 nt, hsa
caauaauuguucacauuguucuuuuauauauauuuauauauauauauaaaaauugggucuuaga

SEQ ID NO: 755934 - RNA, 64 nt, hsa
auaauuguucacauuguucuuuuauauauauuuauauauauauauaaaaauugggucuuagauu

SEQ ID NO: 755935 - RNA, 64 nt, hsa
aauuguucacauuguucuuuuauauauauuuauauauauauauaaaaauugggucuuagauuuu

SEQ ID NO: 755936 - RNA, 64 nt, hsa
uuguucacauuguucuuuuauauauauuuauauauauauauaaaaauugggucuuagauuuuga

SEQ ID NO: 755937 - RNA, 64 nt, hsa
uucuguaaacacacacacacagaguauauauguguauauauauauagauauauucaaaaacauu

SEQ ID NO: 755938 - RNA, 64 nt, hsa
cuguaaacacacacacacagaguauauauguguauauauauauagauauauucaaaaacauugc

SEQ ID NO: 755939 - RNA, 64 nt, hsa
guaaacacacacacacagaguauauauguguauauauauauagauauauucaaaaacauugcau

SEQ ID NO: 755940 - RNA, 64 nt, hsa
uguauuuaguuauaauuuuuguaucuuacaacaguauauauaaagacuauuauuaauagacaaa

SEQ ID NO: 755941 - RNA, 64 nt, hsa
guuccuguaguuuuuugaugagaguuauaguuguuauauauacauaaagauaauuuucuuuuca

SEQ ID NO: 755942 - RNA, 64 nt, hsa
gagaauucaguugugauuuuuaacaugugucagauauauauacuaacacgucuaauauauacua

SEQ ID NO: 755943 - RNA, 64 nt, hsa
auauaguauauuuauacucuagaacaugcacauuuauauauauauguauauguauauauauaua

SEQ ID NO: 755944 - RNA, 64 nt, hsa
auaguauauuuauacucuagaacaugcacauuuauauauauauguauauguauauauauauagu

SEQ ID NO: 755945 - RNA, 64 nt, hsa
cuagaacaugcacauuuauauauauauguauauguauauauauauaguaacuacuuuuuauacu

SEQ ID NO: 755946 - RNA, 64 nt, hsa
agaacaugcacauuuauauauauauguauauguauauauauauaguaacuacuuuuuauacucc

SEQ ID NO: 755947 - RNA, 64 nt, hsa
aacaugcacauuuauauauauauguauauguauauauauauaguaacuacuuuuuauacuccau

SEQ ID NO: 755948 - RNA, 64 nt, hsa
aauuuuagguuuuagaauagagcugacauuaacauauauauauauauauaaauauauauauaua

SEQ ID NO: 755949 - RNA, 64 nt, hsa
uuuuagguuuuagaauagagcugacauuaacauauauauauauauauaaauauauauauauauu

SEQ ID NO: 755950 - RNA, 64 nt, hsa
uuagguuuuagaauagagcugacauuaacauauauauauauauauaaauauauauauauauuuu

SEQ ID NO: 755951 - RNA, 64 nt, hsa
agguuuuagaauagagcugacauuaacauauauauauauauauaaauauauauauauauuuugu

SEQ ID NO: 755952 - RNA, 64 nt, hsa
guuuuagaauagagcugacauuaacauauauauauauauauaaauauauauauauauuuuguaa

SEQ ID NO: 755953 - RNA, 64 nt, hsa
agagcugacauuaacauauauauauauauauaaauauauauauauauuuuguaauaugagccag

SEQ ID NO: 755954 - RNA, 64 nt, hsa
agcugacauuaacauauauauauauauauaaauauauauauauauuuuguaauaugagccagaa

SEQ ID NO: 755955 - RNA, 64 nt, hsa
cugacauuaacauauauauauauauauaaauauauauauauauuuuguaauaugagccagaauu

SEQ ID NO: 755956 - RNA, 64 nt, hsa
uuugguacuuuuuccccuaauuccaacacuaguuuauauauauagcgaauaaaucuaguuguau

SEQ ID NO: 755957 - RNA, 64 nt, hsa
ugguacuuuuuccccuaauuccaacacuaguuuauauauauagcgaauaaaucuaguuguauaa

SEQ ID NO: 755958 - RNA, 64 nt, hsa
caaaaucaucuauauuuauagaggaauagaaguuuauauauauauaauaccauauuuuuaauuu

SEQ ID NO: 755959 - RNA, 64 nt, hsa
aaaucaucuauauuuauagaggaauagaaguuuauauauauauaauaccauauuuuuaauuuca

SEQ ID NO: 755960 - RNA, 64 nt, hsa
aucaucuauauuuauagaggaauagaaguuuauauauauauaauaccauauuuuuaauuucaca

SEQ ID NO: 755961 - RNA, 64 nt, hsa
gggcaacauaccaagacccccgucucuuuaaaaauauauauauuuuaaauauacuuaaauauau

SEQ ID NO: 755962 - RNA, 64 nt, hsa
auauacuuaaauauauauuucuaauaucuuuaaauauauauauauauuuuaaagaccaauuuau

SEQ ID NO: 755963 - RNA, 64 nt, hsa
auacuuaaauauauauuucuaauaucuuuaaauauauauauauauuuuaaagaccaauuuaugg

SEQ ID NO: 755964 - RNA, 64 nt, hsa
acuuaaauauauauuucuaauaucuuuaaauauauauauauauuuuaaagaccaauuuauggga

SEQ ID NO: 755965 - RNA, 64 nt, hsa
gugauuucauuuugggaaacagguuucaaaugaauauauauacauggguaaaauuacucugugc

SEQ ID NO: 755966 - RNA, 64 nt, hsa
augaaaaugugguuagaauguuaauuggauaauguauauauaagaaguuaaaguauguaaagua

SEQ ID NO: 755967 - RNA, 64 nt, hsa
accagcaaauuauauguggacagguucuaaacucuauauauacauauauauauauauaucuaua

SEQ ID NO: 755968 - RNA, 64 nt, hsa
uauauguggacagguucuaaacucuauauauacauauauauauauauaucuauauaucuauaua

SEQ ID NO: 755969 - RNA, 64 nt, hsa
uauguggacagguucuaaacucuauauauacauauauauauauauaucuauauaucuauauacg

SEQ ID NO: 755970 - RNA, 64 nt, hsa
uguggacagguucuaaacucuauauauacauauauauauauauaucuauauaucuauauacgua

SEQ ID NO: 755971 - RNA, 64 nt, hsa
uggacagguucuaaacucuauauauacauauauauauauauaucuauauaucuauauacguaau

SEQ ID NO: 755972 - RNA, 64 nt, hsa
uguauauguguacauauggacauacacauuuacauauauauaaaguauauauauacauauauau

SEQ ID NO: 755973 - RNA, 64 nt, hsa
acauauggacauacacauuuacauauauauaaaguauauauauacauauauauauauauauaug

SEQ ID NO: 755974 - RNA, 64 nt, hsa
auauggacauacacauuuacauauauauaaaguauauauauacauauauauauauauauaugua

SEQ ID NO: 755975 - RNA, 64 nt, hsa
acacauuuacauauauauaaaguauauauauacauauauauauauauauauguaugaaacccgc

SEQ ID NO: 755976 - RNA, 64 nt, hsa
acauuuacauauauauaaaguauauauauacauauauauauauauauauguaugaaacccgcau

SEQ ID NO: 755977 - RNA, 64 nt, hsa
auuuacauauauauaaaguauauauauacauauauauauauauauauguaugaaacccgcaugg

SEQ ID NO: 755978 - RNA, 64 nt, hsa
uuacauauauauaaaguauauauauacauauauauauauauauauguaugaaacccgcauggaa

SEQ ID NO: 755979 - RNA, 64 nt, hsa
acauauauauaaaguauauauauacauauauauauauauauauguaugaaacccgcauggaauu

SEQ ID NO: 755980 - RNA, 64 nt, hsa
uaauaaagugaaauugguauacuuuccaguuaaauauauauauauauauauuuuuucuuacuuu

SEQ ID NO: 755981 - RNA, 64 nt, hsa
auaaagugaaauugguauacuuuccaguuaaauauauauauauauauauuuuuucuuacuuuau

SEQ ID NO: 755982 - RNA, 64 nt, hsa
aaagugaaauugguauacuuuccaguuaaauauauauauauauauauuuuuucuuacuuuaucu

SEQ ID NO: 755983 - RNA, 64 nt, hsa
agugaaauugguauacuuuccaguuaaauauauauauauauauauuuuuucuuacuuuaucuuu

SEQ ID NO: 755984 - RNA, 64 nt, hsa
ugaaauugguauacuuuccaguuaaauauauauauauauauauuuuuucuuacuuuaucuuuua

SEQ ID NO: 755985 - RNA, 64 nt, hsa
uggauggauuacuaauauuugauuuauuacucaauauauauauaauuccagccuuggaaaguag

SEQ ID NO: 755986 - RNA, 64 nt, hsa
gauggauuacuaauauuugauuuauuacucaauauauauauaauuccagccuuggaaaguagga

SEQ ID NO: 755987 - RNA, 64 nt, hsa
aaauauguuuaauguauauaaugugauuuuuaaauauauauauauauauacacacauugugaaa

SEQ ID NO: 755988 - RNA, 64 nt, hsa
auauguuuaauguauauaaugugauuuuuaaauauauauauauauauacacacauugugaaaua

SEQ ID NO: 755989 - RNA, 64 nt, hsa
auguuuaauguauauaaugugauuuuuaaauauauauauauauauacacacauugugaaauaau

SEQ ID NO: 755990 - RNA, 64 nt, hsa
guuuaauguauauaaugugauuuuuaaauauauauauauauauacacacauugugaaauaauga

SEQ ID NO: 755991 - RNA, 64 nt, hsa
uuaauguauauaaugugauuuuuaaauauauauauauauauacacacauugugaaauaaugaaa

SEQ ID NO: 755992 - RNA, 64 nt, hsa
guccauuaucuauauaguccugucuugucuauuguauauauaaucuauaugauuaaagaaaaua

SEQ ID NO: 755993 - RNA, 64 nt, hsa
ggcauuagugcugauagcuguguguguuagcuuguauauauauuuuuaaaaaucuaccuguucc

SEQ ID NO: 755994 - RNA, 64 nt, hsa
gaauuauuuuaaaagauaaauauuauauuauauauauauauauuucccugaaggaaccaaagcg

SEQ ID NO: 755995 - RNA, 64 nt, hsa
uggaauuauuuuaaaagauaaauauuauauuauauauauauauauuucccugaaggaaccaaag

SEQ ID NO: 755996 - RNA, 64 nt, hsa
gguggaauuauuuuaaaagauaaauauuauauuauauauauauauauuucccugaaggaaccaa

SEQ ID NO: 755997 - RNA, 64 nt, hsa
gagguggaauuauuuuaaaagauaaauauuauauuauauauauauauauuucccugaaggaacc

SEQ ID NO: 755998 - RNA, 64 nt, hsa
caaaaguucucaauguucuuuuccaacacaucuauauauauauggacacacagucacgcaagcu

SEQ ID NO: 755999 - RNA, 64 nt, hsa
ugcaaaaguucucaauguucuuuuccaacacaucuauauauauauggacacacagucacgcaag

SEQ ID NO: 756000 - RNA, 64 nt, hsa
gugaacguggcccgcaugugcauucuuuuuuuuauauauauaaagucagugacgaggaacuccc

SEQ ID NO: 756001 - RNA, 64 nt, hsa
cugugaacguggcccgcaugugcauucuuuuuuuuauauauauaaagucagugacgaggaacuc

SEQ ID NO: 756002 - RNA, 64 nt, hsa
augagugggaagacugaucuauauauuauauauauauauauauuuuuaaggugaaauacuaaac

SEQ ID NO: 756003 - RNA, 64 nt, hsa
ugaugagugggaagacugaucuauauauuauauauauauauauauuuuuaaggugaaauacuaa

SEQ ID NO: 756004 - RNA, 63 nt, hsa
augaugagugggaagacugaucuauauauuauauauauauauauauuuuuaaggugaaauacu

SEQ ID NO: 756005 - RNA, 61 nt, hsa
augaugagugggaagacugaucuauauauuauauauauauauauauuuuuaaggugaaaua

SEQ ID NO: 756006 - RNA, 59 nt, hsa
augaugagugggaagacugaucuauauauuauauauauauauauauuuuuaaggugaaa

SEQ ID NO: 756007 - RNA, 64 nt, hsa
ugaauauucaauuuuauacaaacauuuauauauauauauauagauuuguguauguuauuugcca

SEQ ID NO: 756008 - RNA, 64 nt, hsa
caugaauauucaauuuuauacaaacauuuauauauauauauauagauuuguguauguuauuugc

SEQ ID NO: 756009 - RNA, 64 nt, hsa
aucaugaauauucaauuuuauacaaacauuuauauauauauauauagauuuguguauguuauuu

SEQ ID NO: 756010 - RNA, 64 nt, hsa
aaaucaugaauauucaauuuuauacaaacauuuauauauauauauauagauuuguguauguuau

SEQ ID NO: 756011 - RNA, 64 nt, hsa
uaaaaucaugaauauucaauuuuauacaaacauuuauauauauauauauagauuuguguauguu

SEQ ID NO: 756012 - RNA, 64 nt, hsa
cuaaacaagguuuuuaugaauaauagcauugauauauauauauuauauaucacccuuuagaucu

SEQ ID NO: 756013 - RNA, 64 nt, hsa
uacuaaacaagguuuuuaugaauaauagcauugauauauauauauuauauaucacccuuuagau

SEQ ID NO: 756014 - RNA, 64 nt, hsa
agcugagggguuaauauauauacauacauacacauauauauauuuuuguaaauaaacaggaacu

SEQ ID NO: 756015 - RNA, 64 nt, hsa
aaaggaugaucaugggagggagcugagggguuaauauauauacauacauacacauauauauauu

SEQ ID NO: 756016 - RNA, 64 nt, hsa
aucauguaaucacaguuuaaugacaguuuauguauauauauaauucaguauucccucugauaac

SEQ ID NO: 756017 - RNA, 64 nt, hsa
guaucauguaaucacaguuuaaugacaguuuauguauauauauaauucaguauucccucugaua

SEQ ID NO: 756018 - RNA, 64 nt, hsa
auuaaaaugugaaauuuugcguacucucucucucuauauauauaguucaaaaauacuuuaggug

SEQ ID NO: 756019 - RNA, 64 nt, hsa
uaaaaugugaaauuuugcguacucucucucucuauauauauaguucaaaaauacuuuagguggu

SEQ ID NO: 756020 - RNA, 64 nt, hsa
ccauuuacgcuacaugugauuuuuuuaauguauguauauauauauauucucaaauugcucuauc

SEQ ID NO: 756021 - RNA, 64 nt, hsa
auuuacgcuacaugugauuuuuuuaauguauguauauauauauauucucaaauugcucuaucag

SEQ ID NO: 756022 - RNA, 64 nt, hsa
uuacgcuacaugugauuuuuuuaauguauguauauauauauauucucaaauugcucuaucagcu

SEQ ID NO: 756023 - RNA, 64 nt, hsa
aaacagauaaaaugcaucuuguuacuacaaauguuauauauauaaaaucaaguugagcuuugcc

SEQ ID NO: 756024 - RNA, 64 nt, hsa
acagauaaaaugcaucuuguuacuacaaauguuauauauauaaaaucaaguugagcuuugccuu

SEQ ID NO: 756025 - RNA, 64 nt, hsa
uguuuguuaacaguuacauauguuuguaugaguguauauauauaucuguguguguguaucucua

SEQ ID NO: 756026 - RNA, 64 nt, hsa
uuuguuaacaguuacauauguuuguaugaguguauauauauaucuguguguguguaucucuaac

SEQ ID NO: 756027 - RNA, 64 nt, hsa
cugguaaauuguagaacaauugcauguguuuaaauauauauacaaacauaucacacauuaaaua

SEQ ID NO: 756028 - RNA, 64 nt, hsa
uuuaaauauauauacaaacauaucacacauuaaauauauauauauuuaaaucaugcuuuguuaa

SEQ ID NO: 756029 - RNA, 64 nt, hsa
uaaauauauauacaaacauaucacacauuaaauauauauauauuuaaaucaugcuuuguuaaua

SEQ ID NO: 756030 - RNA, 64 nt, hsa
aggaaauauaaugauuucugggaacaugggcauguauauauauauauggagagagaauuuugca

SEQ ID NO: 756031 - RNA, 64 nt, hsa
gaaauauaaugauuucugggaacaugggcauguauauauauauauggagagagaauuuugcaca

SEQ ID NO: 756032 - RNA, 64 nt, hsa
aauauaaugauuucugggaacaugggcauguauauauauauauggagagagaauuuugcacaua

SEQ ID NO: 756033 - RNA, 64 nt, hsa
uuuuauucucaaguggagaacuucucccacauaauauauauauauauauauauuuuaauuuaug

SEQ ID NO: 756034 - RNA, 64 nt, hsa
uuauucucaaguggagaacuucucccacauaauauauauauauauauauauuuuaauuuaugag

SEQ ID NO: 756035 - RNA, 64 nt, hsa
auucucaaguggagaacuucucccacauaauauauauauauauauauauuuuaauuuaugagaa

SEQ ID NO: 756036 - RNA, 64 nt, hsa
ucucaaguggagaacuucucccacauaauauauauauauauauauauuuuaauuuaugagaauu

SEQ ID NO: 756037 - RNA, 64 nt, hsa
ucaaguggagaacuucucccacauaauauauauauauauauauauuuuaauuuaugagaauuuu

SEQ ID NO: 756038 - RNA, 64 nt, hsa
aaguggagaacuucucccacauaauauauauauauauauauauuuuaauuuaugagaauuuugg

SEQ ID NO: 756039 - RNA, 64 nt, hsa
aacaguaccaaaccuuuauacacuguuuuuuccauauauauauaccuaugauaaaguauaaugu

SEQ ID NO: 756040 - RNA, 64 nt, hsa
caguaccaaaccuuuauacacuguuuuuuccauauauauauaccuaugauaaaguauaauguau

SEQ ID NO: 756041 - RNA, 64 nt, hsa
cuguaucucaacauuuucuuuuuaaaggaaaaaauauauauauauaguuucuuuuuauugauca

SEQ ID NO: 756042 - RNA, 64 nt, hsa
guaucucaacauuuucuuuuuaaaggaaaaaauauauauauauaguuucuuuuuauugaucagg

SEQ ID NO: 756043 - RNA, 64 nt, hsa
aucucaacauuuucuuuuuaaaggaaaaaauauauauauauaguuucuuuuuauugaucagguc

SEQ ID NO: 756044 - RNA, 64 nt, hsa
accaguccauccaaaaccuauauaucaccuauacuauauauaucauauauauaguugaauggca

SEQ ID NO: 756045 - RNA, 64 nt, hsa
caaaaccuauauaucaccuauacuauauauaucauauauauaguugaauggcaguauucaggcu

SEQ ID NO: 756046 - RNA, 64 nt, hsa
aagaggaaaacuagaauauauauauauauauacauauauauaaaaagucaaaauuguaauaacu

SEQ ID NO: 756047 - RNA, 64 nt, hsa
aaauaacacaaagaggaaaacuagaauauauauauauauauacauauauauaaaaagucaaaau

SEQ ID NO: 756048 - RNA, 64 nt, hsa
aaaaauaacacaaagaggaaaacuagaauauauauauauauauacauauauauaaaaagucaaa

SEQ ID NO: 756049 - RNA, 64 nt, hsa
aaaaaaauaacacaaagaggaaaacuagaauauauauauauauauacauauauauaaaaaguca

SEQ ID NO: 756050 - RNA, 64 nt, hsa
aaaaaaaaauaacacaaagaggaaaacuagaauauauauauauauauacauauauauaaaaagu

SEQ ID NO: 756051 - RNA, 64 nt, hsa
aaaaaaaaaaauaacacaaagaggaaaacuagaauauauauauauauauacauauauauaaaaa

SEQ ID NO: 756052 - RNA, 64 nt, hsa
cuuauuuuuuuguguauaucuuugcaaucuauuuuauauauauugacaaaagagacugugaaau

SEQ ID NO: 756053 - RNA, 64 nt, hsa
aaaacaacaaaauauauauauauucucauauauauauauauagcugauaaaauuaccugaggag

SEQ ID NO: 756054 - RNA, 64 nt, hsa
acaaaacaacaaaauauauauauauucucauauauauauauauagcugauaaaauuaccugagg

SEQ ID NO: 756055 - RNA, 64 nt, hsa
guacaaaacaacaaaauauauauauauucucauauauauauauauagcugauaaaauuaccuga

SEQ ID NO: 756056 - RNA, 64 nt, hsa
ugguacaaaacaacaaaauauauauauauucucauauauauauauauagcugauaaaauuaccu

SEQ ID NO: 756057 - RNA, 64 nt, hsa
auaauggagagauuugguacaaaacaacaaaauauauauauauucucauauauauauauauagc

SEQ ID NO: 756058 - RNA, 64 nt, hsa
aaauaauggagagauuugguacaaaacaacaaaauauauauauauucucauauauauauauaua

SEQ ID NO: 756059 - RNA, 64 nt, hsa
cuuccauaagaagaaauggagaaaaaaauauauauauauauauugugaaagaucaauccaucug

SEQ ID NO: 756060 - RNA, 64 nt, hsa
ggcuuccauaagaagaaauggagaaaaaaauauauauauauauauugugaaagaucaauccauc

SEQ ID NO: 756061 - RNA, 64 nt, hsa
cuggcuuccauaagaagaaauggagaaaaaaauauauauauauauauugugaaagaucaaucca

SEQ ID NO: 756062 - RNA, 64 nt, hsa
uucuggcuuccauaagaagaaauggagaaaaaaauauauauauauauauugugaaagaucaauc

SEQ ID NO: 756063 - RNA, 64 nt, hsa
ugggucagaucaugggacauaacuucuuagaauauauauauacauauguacauauucucauaug

SEQ ID NO: 756064 - RNA, 64 nt, hsa
uaugggucagaucaugggacauaacuucuuagaauauauauauacauauguacauauucucaua

SEQ ID NO: 756065 - RNA, 64 nt, hsa
aaaacaguucagaauauuuuuuuaaaaaaaauucuauauauacuguaaaauuauaaauuuuuuu

SEQ ID NO: 756066 - RNA, 64 nt, hsa
uauguauguauguguauguguguguguguguguguauauauacacacacacacacauacuuaaa

SEQ ID NO: 756067 - RNA, 64 nt, hsa
aaauuguaauaauguaaaugggggcuucaauauauauauauaauacacacacacacacacaugc

SEQ ID NO: 756068 - RNA, 64 nt, hsa
guaaauuguaauaauguaaaugggggcuucaauauauauauauaauacacacacacacacacau

SEQ ID NO: 756069 - RNA, 64 nt, hsa
auguaaauuguaauaauguaaaugggggcuucaauauauauauauaauacacacacacacacac

SEQ ID NO: 756070 - RNA, 64 nt, hsa
auagcuacauuugguuuauucaucauauuuacaguauauauauuguucuuuucaguguucacau

SEQ ID NO: 756071 - RNA, 64 nt, hsa
aucuguauaaaacauauuuuuggauaaauauauauauauauauuuguaucucuacagaaaggcu

SEQ ID NO: 756072 - RNA, 64 nt, hsa
uuaucuguauaaaacauauuuuuggauaaauauauauauauauauuuguaucucuacagaaagg

SEQ ID NO: 756073 - RNA, 64 nt, hsa
auuuaucuguauaaaacauauuuuuggauaaauauauauauauauauuuguaucucuacagaaa

SEQ ID NO: 756074 - RNA, 64 nt, hsa
acauuuaucuguauaaaacauauuuuuggauaaauauauauauauauauuuguaucucuacaga

SEQ ID NO: 756075 - RNA, 64 nt, hsa
uuacuaucuaaaaguuuaucgguaucuugauguauauauauauuaagguguggcuguuuaaaau

SEQ ID NO: 756076 - RNA, 64 nt, hsa
cuuuacuaucuaaaaguuuaucgguaucuugauguauauauauauuaagguguggcuguuuaaa

SEQ ID NO: 756077 - RNA, 64 nt, hsa
aauacaaaaggcuccauauauauauauauauauauauauauacacacacacacacgcacauaua

SEQ ID NO: 756078 - RNA, 64 nt, hsa
auaauacaaaaggcuccauauauauauauauauauauauauauacacacacacacacgcacaua

SEQ ID NO: 756079 - RNA, 64 nt, hsa
ccauaauacaaaaggcuccauauauauauauauauauauauauauacacacacacacacgcaca

SEQ ID NO: 756080 - RNA, 64 nt, hsa
ugccauaauacaaaaggcuccauauauauauauauauauauauauauacacacacacacacgca

SEQ ID NO: 756081 - RNA, 64 nt, hsa
aaugccauaauacaaaaggcuccauauauauauauauauauauauauauacacacacacacacg

SEQ ID NO: 756082 - RNA, 64 nt, hsa
aaaaugccauaauacaaaaggcuccauauauauauauauauauauauauauacacacacacaca

SEQ ID NO: 756083 - RNA, 64 nt, hsa
aaaaaaugccauaauacaaaaggcuccauauauauauauauauauauauauauacacacacaca

SEQ ID NO: 756084 - RNA, 64 nt, hsa
aaaaaaaaugccauaauacaaaaggcuccauauauauauauauauauauauauauacacacaca

SEQ ID NO: 756085 - RNA, 64 nt, hsa
gaaaaaaaaaugccauaauacaaaaggcuccauauauauauauauauauauauauauacacaca

SEQ ID NO: 756086 - RNA, 64 nt, hsa
aagaaaaaaaaaugccauaauacaaaaggcuccauauauauauauauauauauauauauacaca

SEQ ID NO: 756087 - RNA, 64 nt, hsa
auuguuguaaaacuuaauuucuccccaguuuuuauauauauauuuuuuagaguuccguuuuuau

SEQ ID NO: 756088 - RNA, 64 nt, hsa
caauuguuguaaaacuuaauuucuccccaguuuuuauauauauauuuuuuagaguuccguuuuu

SEQ ID NO: 756089 - RNA, 64 nt, hsa
cugguaacuguuaacccaguguucagcauagagcuauauauauauauauauguauauauuuauu

SEQ ID NO: 756090 - RNA, 64 nt, hsa
gguaacuguuaacccaguguucagcauagagcuauauauauauauauauguauauauuuauuau

SEQ ID NO: 756091 - RNA, 64 nt, hsa
uaacuguuaacccaguguucagcauagagcuauauauauauauauauguauauauuuauuauuu

SEQ ID NO: 756092 - RNA, 64 nt, hsa
acuguuaacccaguguucagcauagagcuauauauauauauauauguauauauuuauuauuuuc

SEQ ID NO: 756093 - RNA, 64 nt, hsa
uguuaacccaguguucagcauagagcuauauauauauauauauguauauauuuauuauuuucau

SEQ ID NO: 756094 - RNA, 64 nt, hsa
cuuuaaaaccauaucagagaugcauacaaagaauuauauauaaagaaggguguuuaauaaugau

SEQ ID NO: 756095 - RNA, 64 nt, hsa
ugcuauguaaauauacaaaaaaacuagaaagaaauauauauaaccuuguuauuguauuuggggg

SEQ ID NO: 756096 - RNA, 64 nt, hsa
ugagaagcauguaauguuaauguuauaucauauguauauauauauaugcacuauguauauacau

SEQ ID NO: 756097 - RNA, 64 nt, hsa
agaagcauguaauguuaauguuauaucauauguauauauauauaugcacuauguauauacauau

SEQ ID NO: 756098 - RNA, 64 nt, hsa
aagcauguaauguuaauguuauaucauauguauauauauauaugcacuauguauauacauauau

SEQ ID NO: 756099 - RNA, 64 nt, hsa
cuuggauacaccaauuagaaauuaaauaagcaaauauauauauauauauaaauauagcagguua

SEQ ID NO: 756100 - RNA, 64 nt, hsa
uggauacaccaauuagaaauuaaauaagcaaauauauauauauauauaaauauagcagguuaca

SEQ ID NO: 756101 - RNA, 64 nt, hsa
gauacaccaauuagaaauuaaauaagcaaauauauauauauauauaaauauagcagguuacaua

SEQ ID NO: 756102 - RNA, 64 nt, hsa
uacaccaauuagaaauuaaauaagcaaauauauauauauauauaaauauagcagguuacauaua

SEQ ID NO: 756103 - RNA, 64 nt, hsa
caccaauuagaaauuaaauaagcaaauauauauauauauauaaauauagcagguuacauauaua

SEQ ID NO: 756104 - RNA, 64 nt, hsa
aauauauauauauauauaaauauagcagguuacauauauauauuuauaaugugucuuuuuauua

SEQ ID NO: 756105 - RNA, 64 nt, hsa
ugacauauaagccguauauagaucaauguccacauauauauacacacacacauauauauauaua

SEQ ID NO: 756106 - RNA, 64 nt, hsa
uagaucaauguccacauauauauacacacacacauauauauauauaaaguguaacaaggaacac

SEQ ID NO: 756107 - RNA, 64 nt, hsa
gaucaauguccacauauauauacacacacacauauauauauauaaaguguaacaaggaacacua

SEQ ID NO: 756108 - RNA, 64 nt, hsa
ucaauguccacauauauauacacacacacauauauauauauaaaguguaacaaggaacacuaaa

SEQ ID NO: 756109 - RNA, 64 nt, hsa
auuuuuuuucuaaaccuuuuuuuuuuaauauacauauauauauauauauauauauauauauaua

SEQ ID NO: 756110 - RNA, 64 nt, hsa
uuuuuuucuaaaccuuuuuuuuuuaauauacauauauauauauauauauauauauauauauaua

SEQ ID NO: 756111 - RNA, 64 nt, hsa
uuuuucuaaaccuuuuuuuuuuaauauacauauauauauauauauauauauauauauauauaua

SEQ ID NO: 756112 - RNA, 64 nt, hsa
uuucuaaaccuuuuuuuuuuaauauacauauauauauauauauauauauauauauauauauaua

SEQ ID NO: 756113 - RNA, 64 nt, hsa
ucuaaaccuuuuuuuuuuaauauacauauauauauauauauauauauauauauauauauauaua

SEQ ID NO: 756114 - RNA, 64 nt, hsa
uaaaccuuuuuuuuuuaauauacauauauauauauauauauauauauauauauauauauauaua

SEQ ID NO: 756115 - RNA, 64 nt, hsa
aaccuuuuuuuuuuaauauacauauauauauauauauauauauauauauauauauauauauaua

SEQ ID NO: 756116 - RNA, 64 nt, hsa
ccuuuuuuuuuuaauauacauauauauauauauauauauauauauauauauauauauauauaua

SEQ ID NO: 756117 - RNA, 64 nt, hsa
uuuuuuuuuuaauauacauauauauauauauauauauauauauauauauauauauauauauaua

SEQ ID NO: 756118 - RNA, 64 nt, hsa
uuuuuuuuaauauacauauauauauauauauauauauauauauauauauauauauauauauaua

SEQ ID NO: 756119 - RNA, 64 nt, hsa
uuuuuuaauauacauauauauauauauauauauauauauauauauauauauauauauauauagu

SEQ ID NO: 756120 - RNA, 64 nt, hsa
uuuuaauauacauauauauauauauauauauauauauauauauauauauauauauauauagugg

SEQ ID NO: 756121 - RNA, 64 nt, hsa
uuaauauacauauauauauauauauauauauauauauauauauauauauauauauauagugggg

SEQ ID NO: 756122 - RNA, 64 nt, hsa
aauauacauauauauauauauauauauauauauauauauauauauauauauauauagugggggu

SEQ ID NO: 756123 - RNA, 64 nt, hsa
uauacauauauauauauauauauauauauauauauauauauauauauauauauagugggggugg

SEQ ID NO: 756124 - RNA, 64 nt, hsa
uacauauauauauauauauauauauauauauauauauauauauauauauauagugggggugggg

SEQ ID NO: 756125 - RNA, 64 nt, hsa
cauauauauauauauauauauauauauauauauauauauauauauauauaguggggguggggca

SEQ ID NO: 756126 - RNA, 64 nt, hsa
uauauauauauauauauauauauauauauauauauauauauauauauaguggggguggggcaag

SEQ ID NO: 756127 - RNA, 64 nt, hsa
uauauauauauauauauauauauauauauauauauauauauauauaguggggguggggcaaggg

SEQ ID NO: 756128 - RNA, 64 nt, hsa
uauauauauauauauauauauauauauauauauauauauauauaguggggguggggcaagggau

SEQ ID NO: 756129 - RNA, 64 nt, hsa
uauauauauauauauauauauauauauauauauauauauauaguggggguggggcaagggauca

SEQ ID NO: 756130 - RNA, 64 nt, hsa
uguguguguguguguguguguguguguguguauguauauauauauauaaauaucuuucccaaua

SEQ ID NO: 756131 - RNA, 64 nt, hsa
uguguguguguguguguguguguguguguauguauauauauauauaaauaucuuucccaauaug

SEQ ID NO: 756132 - RNA, 64 nt, hsa
uguguguguguguguguguguguguguauguauauauauauauaaauaucuuucccaauaugcc

SEQ ID NO: 756133 - RNA, 64 nt, hsa
uguguguguguguguguguguguguauguauauauauauauaaauaucuuucccaauaugcccc

SEQ ID NO: 756134 - RNA, 64 nt, hsa
uuauaguacaaucacauugcuuugauuuuguguauauauauauuuaucuguguuuuaagauugu

SEQ ID NO: 756135 - RNA, 64 nt, hsa
auuuauaguacaaucacauugcuuugauuuuguguauauauauauuuaucuguguuuuaagauu

SEQ ID NO: 756136 - RNA, 64 nt, hsa
cuggguguaagaagggaaauuggaaaaaaaauuauauauauauucuccuuuuaauggugggggg

SEQ ID NO: 756137 - RNA, 64 nt, hsa
cucuggguguaagaagggaaauuggaaaaaaaauuauauauauauucuccuuuuaauggugggg

SEQ ID NO: 756138 - RNA, 64 nt, hsa
agcagaguucccuauuccccuggcauaaagaauguauauauauuuugaaauauggcugagaaca

SEQ ID NO: 756139 - RNA, 64 nt, hsa
aaccuguaaaacaccacuccuccuuccaaaguuguauauauaauauugcagguuaaauuacuuu

SEQ ID NO: 756140 - RNA, 64 nt, hsa
aauacauauggaauauauauauuuuauauauauauauauauauuuuuauuuuugagauggaguu

SEQ ID NO: 756141 - RNA, 64 nt, hsa
aaaauacauauggaauauauauauuuuauauauauauauauauauuuuuauuuuugagauggag

SEQ ID NO: 756142 - RNA, 64 nt, hsa
auaaaauacauauggaauauauauauuuuauauauauauauauauauuuuuauuuuugagaugg

SEQ ID NO: 756143 - RNA, 64 nt, hsa
auauaaaauacauauggaauauauauauuuuauauauauauauauauauuuuuauuuuugagau

SEQ ID NO: 756144 - RNA, 64 nt, hsa
auauauaaaauacauauggaauauauauauuuuauauauauauauauauauuuuuauuuuugag

SEQ ID NO: 756145 - RNA, 64 nt, hsa
auauauauaaaauacauauggaauauauauauuuuauauauauauauauauauuuuuauuuuug

SEQ ID NO: 756146 - RNA, 64 nt, hsa
auauauauauuauauauauaaaauacauauggaauauauauauuuuauauauauauauauauau

SEQ ID NO: 756147 - RNA, 64 nt, hsa
uuauauauauaauauauauggaauauauauauuauauauauaaaauacauauggaauauauaua

SEQ ID NO: 756148 - RNA, 64 nt, hsa
uuuuauauauauaauauauauggaauauauauauuauauauauaaaauacauauggaauauaua

SEQ ID NO: 756149 - RNA, 64 nt, hsa
uauauauauuuuuauauauauaauauauauggaauauauauauuauauauauaaaauacauaug

SEQ ID NO: 756150 - RNA, 64 nt, hsa
uauauauggaauauguauauuauauauauuuuuauauauauaauauauauggaauauauauauu

SEQ ID NO: 756151 - RNA, 64 nt, hsa
aauauauauggaauauguauauuauauauauuuuuauauauauaauauauauggaauauauaua

SEQ ID NO: 756152 - RNA, 64 nt, hsa
ccuuccauauauaauauauauggaauauguauauuauauauauuuuuauauauauaauauauau

SEQ ID NO: 756153 - RNA, 64 nt, hsa
auuugucaccucacccacagauuguauuuaugucuauauauauguucauaaaaaguuaugugau

SEQ ID NO: 756154 - RNA, 64 nt, hsa
cucuagugucuuauuaguuaaacuuuguaaaauauauauauacuuguuuuuccauuguaugcaa

SEQ ID NO: 756155 - RNA, 64 nt, hsa
ugcucuagugucuuauuaguuaaacuuuguaaaauauauauauacuuguuuuuccauuguaugc

SEQ ID NO: 756156 - RNA, 64 nt, hsa
uuccuuaauguuagugagauauauauauauuauauauauauauuuuuuuuuugguuaggaagug

SEQ ID NO: 756157 - RNA, 64 nt, hsa
uuuuccuuaauguuagugagauauauauauauuauauauauauauuuuuuuuuugguuaggaag

SEQ ID NO: 756158 - RNA, 64 nt, hsa
gcuuuuccuuaauguuagugagauauauauauauuauauauauauauuuuuuuuuugguuagga

SEQ ID NO: 756159 - RNA, 64 nt, hsa
acaaccgacgcuuuuccuuaauguuagugagauauauauauauuauauauauauauuuuuuuuu

SEQ ID NO: 756160 - RNA, 64 nt, hsa
gcacaaccgacgcuuuuccuuaauguuagugagauauauauauauuauauauauauauuuuuuu

SEQ ID NO: 756161 - RNA, 64 nt, hsa
auuaaaaauguguguguauguguguguguguguguauauauauauauauuuuuaaaucacauua

SEQ ID NO: 756162 - RNA, 64 nt, hsa
uaaaaauguguguguauguguguguguguguguauauauauauauauuuuuaaaucacauuaau

SEQ ID NO: 756163 - RNA, 64 nt, hsa
aaaauguguguguauguguguguguguguguauauauauauauauuuuuaaaucacauuaauuu

SEQ ID NO: 756164 - RNA, 64 nt, hsa
aauguguguguauguguguguguguguguauauauauauauauuuuuaaaucacauuaauuuua

SEQ ID NO: 756165 - RNA, 64 nt, hsa
aggccauuuuagguggcucacuuucucauuaagauauauauauagaaccacuuuuuguagauua

SEQ ID NO: 756166 - RNA, 64 nt, hsa
gccauuuuagguggcucacuuucucauuaagauauauauauagaaccacuuuuuguagauuagu

SEQ ID NO: 756167 - RNA, 64 nt, hsa
ugaucaagccacugaaucacuuugcauuucaguuuauauauauagagagaaagaaggugucugc

SEQ ID NO: 756168 - RNA, 64 nt, hsa
aucaagccacugaaucacuuugcauuucaguuuauauauauagagagaaagaaggugucugcuc

SEQ ID NO: 756169 - RNA, 64 nt, hsa
cuauacagccacugugcccuguggaauaaagccauauauauaaauguuuuauauguauauguuu

SEQ ID NO: 756170 - RNA, 64 nt, hsa
uauguuuuauacauaaauaaaacauuucaucuaauauauauaugugugugugaguauaugugug

SEQ ID NO: 756171 - RNA, 64 nt, hsa
aacugaaccuuuuacuaauugugagcuaaagagauauauauauauauguguguguauauauaua

SEQ ID NO: 756172 - RNA, 64 nt, hsa
cugaaccuuuuacuaauugugagcuaaagagauauauauauauauguguguguauauauauaua

SEQ ID NO: 756173 - RNA, 64 nt, hsa
gaaccuuuuacuaauugugagcuaaagagauauauauauauauguguguguauauauauauauc

SEQ ID NO: 756174 - RNA, 64 nt, hsa
gugagcuaaagagauauauauauauauguguguguauauauauauaucuacaugucuuucugua

SEQ ID NO: 756175 - RNA, 64 nt, hsa
gagcuaaagagauauauauauauauguguguguauauauauauaucuacaugucuuucuguagc

SEQ ID NO: 756176 - RNA, 64 nt, hsa
gcuaaagagauauauauauauauguguguguauauauauauaucuacaugucuuucuguagccu

SEQ ID NO: 756177 - RNA, 64 nt, hsa
uaaauguuauuucugcaaacaaacaccuucuuauuauauauauaauauauauauauaucaguuu

SEQ ID NO: 756178 - RNA, 64 nt, hsa
aauguuauuucugcaaacaaacaccuucuuauuauauauauaauauauauauauaucaguuuga

SEQ ID NO: 756179 - RNA, 64 nt, hsa
ucugcaaacaaacaccuucuuauuauauauauaauauauauauauaucaguuugaucacacuau

SEQ ID NO: 756180 - RNA, 64 nt, hsa
ugcaaacaaacaccuucuuauuauauauauaauauauauauauaucaguuugaucacacuauuu

SEQ ID NO: 756181 - RNA, 64 nt, hsa
caaacaaacaccuucuuauuauauauauaauauauauauauaucaguuugaucacacuauuuua

SEQ ID NO: 756182 - RNA, 64 nt, hsa
uagauucccauggccauaaaauggcuuuaaagaauauauauauauuuuuaaaguagcuugagaa

SEQ ID NO: 756183 - RNA, 64 nt, hsa
gauucccauggccauaaaauggcuuuaaagaauauauauauauuuuuaaaguagcuugagaagc

SEQ ID NO: 756184 - RNA, 64 nt, hsa
ugaaguaaaaguugugucuauaauuaaaaaaaaauauauauauauacacacacacauauacaua

SEQ ID NO: 756185 - RNA, 64 nt, hsa
aaguaaaaguugugucuauaauuaaaaaaaaauauauauauauacacacacacauauacauaca

SEQ ID NO: 756186 - RNA, 64 nt, hsa
guaaaaguugugucuauaauuaaaaaaaaauauauauauauacacacacacauauacauacaaa

SEQ ID NO: 756187 - RNA, 64 nt, hsa
ucaaauaacauauguacucaauagguuucaaucauauauauaauauauuuuuuguaacuaugaa

SEQ ID NO: 756188 - RNA, 64 nt, hsa
gguauauguagauagaugugcauguauguguuuguauauauaauuuuauaaguuucacgcauaa

SEQ ID NO: 756189 - RNA, 64 nt, hsa
gccugugugcauacauauguaugggauauauuuguauauauauguacagguaauaaacaucccc

SEQ ID NO: 756190 - RNA, 64 nt, hsa
ugauguuauggaagaaagaaagaaacaaacaaaauauauauauauauguccaaaaacagacaaa

SEQ ID NO: 756191 - RNA, 64 nt, hsa
auguuauggaagaaagaaagaaacaaacaaaauauauauauauauguccaaaaacagacaaauc

SEQ ID NO: 756192 - RNA, 64 nt, hsa
guuauggaagaaagaaagaaacaaacaaaauauauauauauauguccaaaaacagacaaaucca

SEQ ID NO: 756193 - RNA, 64 nt, hsa
ccugagcacacuuauuuuugaaaaugauauaauguauauauaugggaggaaaggccacauuuug

SEQ ID NO: 756194 - RNA, 64 nt, hsa
cuaaacacuggaauacaaaugcaugacucauaucuauauauacaguauauguacauauacuguu

SEQ ID NO: 756195 - RNA, 64 nt, hsa
acagcuguuuaaagucuuuguagcguuuaaaaaauauauauauauacauaacuguuauguaguu

SEQ ID NO: 756196 - RNA, 64 nt, hsa
agcuguuuaaagucuuuguagcguuuaaaaaauauauauauauacauaacuguuauguaguucg

SEQ ID NO: 756197 - RNA, 64 nt, hsa
cuguuuaaagucuuuguagcguuuaaaaaauauauauauauacauaacuguuauguaguucgga

SEQ ID NO: 756198 - RNA, 64 nt, hsa
guuuuugaaucacacugcagcugcuuuccauuuuuauauauauauaaauauauauaaauauaua

SEQ ID NO: 756199 - RNA, 64 nt, hsa
uuuugaaucacacugcagcugcuuuccauuuuuauauauauauaaauauauauaaauauauacu

SEQ ID NO: 756200 - RNA, 64 nt, hsa
uugaaucacacugcagcugcuuuccauuuuuauauauauauaaauauauauaaauauauacuuu

SEQ ID NO: 756201 - RNA, 64 nt, hsa
cugcagcugcuuuccauuuuuauauauauauaaauauauauaaauauauacuuuuuaaaaauaa

SEQ ID NO: 756202 - RNA, 64 nt, hsa
gacccacacaaagguucuggagauuacuggagaauauauauaaauauauauauguacguauaua

SEQ ID NO: 756203 - RNA, 64 nt, hsa
aagguucuggagauuacuggagaauauauauaaauauauauauguacguauauauguaaauaca

SEQ ID NO: 756204 - RNA, 64 nt, hsa
uauauguacguauauauguaaauacacauauacguauauauaaauauauauauacauaugugug

SEQ ID NO: 756205 - RNA, 64 nt, hsa
uauauauguaaauacacauauacguauauauaaauauauauauacauauguguguguauauaua

SEQ ID NO: 756206 - RNA, 64 nt, hsa
uauauguaaauacacauauacguauauauaaauauauauauacauauguguguguauauauaua

SEQ ID NO: 756207 - RNA, 64 nt, hsa
cguauauauaaauauauauauacauauguguguguauauauauauauauuuuuuuuuuuuuuuu

SEQ ID NO: 756208 - RNA, 64 nt, hsa
uauauauaaauauauauauacauauguguguguauauauauauauauuuuuuuuuuuuuuuuuu

SEQ ID NO: 756209 - RNA, 64 nt, hsa
uauauaaauauauauauacauauguguguguauauauauauauauuuuuuuuuuuuuuuuuuuu

SEQ ID NO: 756210 - RNA, 64 nt, hsa
uauaaauauauauauacauauguguguguauauauauauauauuuuuuuuuuuuuuuuuuuuuu

SEQ ID NO: 756211 - RNA, 64 nt, hsa
ugcauuacuacagccagaagaacauauauauauauauauauauuuaaaaauauaucggauaguu

SEQ ID NO: 756212 - RNA, 64 nt, hsa
agugcauuacuacagccagaagaacauauauauauauauauauauuuaaaaauauaucggauag

SEQ ID NO: 756213 - RNA, 64 nt, hsa
acagugcauuacuacagccagaagaacauauauauauauauauauauuuaaaaauauaucggau

SEQ ID NO: 756214 - RNA, 64 nt, hsa
uuacagugcauuacuacagccagaagaacauauauauauauauauauauuuaaaaauauaucgg

SEQ ID NO: 756215 - RNA, 64 nt, hsa
cuuuacagugcauuacuacagccagaagaacauauauauauauauauauauuuaaaaauauauc

SEQ ID NO: 756216 - RNA, 64 nt, hsa
agcuuuacagugcauuacuacagccagaagaacauauauauauauauauauauuuaaaaauaua

SEQ ID NO: 756217 - RNA, 64 nt, hsa
aguguuauuuugauaguuuguggauucuaaaauauauauauauuuauauaaacaccauauaagu

SEQ ID NO: 756218 - RNA, 64 nt, hsa
aaaguguuauuuugauaguuuguggauucuaaaauauauauauauuuauauaaacaccauauaa

SEQ ID NO: 756219 - RNA, 64 nt, hsa
uauacacauauauauguguauguauauauauguauauauauauggcuuuccaauaaccaccuaa

SEQ ID NO: 756220 - RNA, 64 nt, hsa
uauauacacauauauauguguauguauauauauguauauauauauggcuuuccaauaaccaccu

SEQ ID NO: 756221 - RNA, 64 nt, hsa
cacacacauguauauacacauauauauguguauguauauauauguauauauauauggcuuucca

SEQ ID NO: 756222 - RNA, 64 nt, hsa
gcugagcucugguuagguuacagcuggagguguguauauauacacacacacacauguauauaca

SEQ ID NO: 756223 - RNA, 64 nt, hsa
uuuauauguaaauaggcauauaugaagauauauauauauauagucuacuuuuuaaacucugcag

SEQ ID NO: 756224 - RNA, 64 nt, hsa
uauuuauauguaaauaggcauauaugaagauauauauauauauagucuacuuuuuaaacucugc

SEQ ID NO: 756225 - RNA, 64 nt, hsa
ucuauuuauauguaaauaggcauauaugaagauauauauauauauagucuacuuuuuaaacucu

SEQ ID NO: 756226 - RNA, 64 nt, hsa
uaucuauuuauauguaaauaggcauauaugaagauauauauauauauagucuacuuuuuaaacu

SEQ ID NO: 756227 - RNA, 64 nt, hsa
uccauagaauguaauuuauagaugcguguauauguauauauaucuauuuauauguaaauaggca

SEQ ID NO: 756228 - RNA, 64 nt, hsa
caugguguuauucuucaccauguuuauauauauauauauauauuuuuuuuuuuuuuuagaauuu

SEQ ID NO: 756229 - RNA, 64 nt, hsa
cucaugguguuauucuucaccauguuuauauauauauauauauauuuuuuuuuuuuuuuagaau

SEQ ID NO: 756230 - RNA, 64 nt, hsa
accucaugguguuauucuucaccauguuuauauauauauauauauauuuuuuuuuuuuuuuaga

SEQ ID NO: 756231 - RNA, 64 nt, hsa
acaccucaugguguuauucuucaccauguuuauauauauauauauauauuuuuuuuuuuuuuua

SEQ ID NO: 756232 - RNA, 64 nt, hsa
uaacaccucaugguguuauucuucaccauguuuauauauauauauauauauuuuuuuuuuuuuu

SEQ ID NO: 756233 - RNA, 64 nt, hsa
cuuaacaccucaugguguuauucuucaccauguuuauauauauauauauauauuuuuuuuuuuu

SEQ ID NO: 756234 - RNA, 64 nt, hsa
uuaaugauaauuaauaaaguaguuugaagcauuauauauauaaguaauuaugugucuuuaaaau

SEQ ID NO: 756235 - RNA, 64 nt, hsa
gauuaaugauaauuaauaaaguaguuugaagcauuauauauauaaguaauuaugugucuuuaaa

SEQ ID NO: 756236 - RNA, 64 nt, hsa
guuuauauuuuauauacacauauguacaugaauauauauauauucauguaucuuguauauaaaa

SEQ ID NO: 756237 - RNA, 64 nt, hsa
caguuuauauuuuauauacacauauguacaugaauauauauauauucauguaucuuguauauaa

SEQ ID NO: 756238 - RNA, 61 nt, hsa
acaggcuuguaaaggacugaacaugguuauuuauauauauagauaucuguauauacacaca

SEQ ID NO: 756239 - RNA, 63 nt, hsa
acaggcuuguaaaggacugaacaugguuauuuauauauauagauaucuguauauacacacaca

SEQ ID NO: 756240 - RNA, 64 nt, hsa
aauuaagacagaaccaaaugagcuaaguugcaaauauauauauauacacacacacacauauaug

SEQ ID NO: 756241 - RNA, 64 nt, hsa
uuaagacagaaccaaaugagcuaaguugcaaauauauauauauacacacacacacauauaugua

SEQ ID NO: 756242 - RNA, 64 nt, hsa
aagacagaaccaaaugagcuaaguugcaaauauauauauauacacacacacacauauauguaca

SEQ ID NO: 756243 - RNA, 64 nt, hsa
aauuaaauacuauaugaaacuugugccacagagcuauauauaauaugaaaagauuaacuucaua

SEQ ID NO: 756244 - RNA, 64 nt, hsa
uaggacaauacauuauauuaaaauggucucucucuauauauaucuguauaucuuauacaugucc

SEQ ID NO: 756245 - RNA, 64 nt, hsa
uacauacauaagcauauauguguguguguguguguauauauauauauaugcaugcugugaaacu

SEQ ID NO: 756246 - RNA, 64 nt, hsa
cauacauaagcauauauguguguguguguguguauauauauauauaugcaugcugugaaacuug

SEQ ID NO: 756247 - RNA, 64 nt, hsa
uacauaagcauauauguguguguguguguguauauauauauauaugcaugcugugaaacuugac

SEQ ID NO: 756248 - RNA, 64 nt, hsa
cauaagcauauauguguguguguguguguauauauauauauaugcaugcugugaaacuugacua

SEQ ID NO: 756249 - RNA, 64 nt, hsa
ucuucugcguuaccagguguguguguacauauaauauauauauauauauauuauaaauaucaaa

SEQ ID NO: 756250 - RNA, 64 nt, hsa
uucugcguuaccagguguguguguacauauaauauauauauauauauauuauaaauaucaaaga

SEQ ID NO: 756251 - RNA, 64 nt, hsa
cugcguuaccagguguguguguacauauaauauauauauauauauauuauaaauaucaaagaaa

SEQ ID NO: 756252 - RNA, 64 nt, hsa
gcguuaccagguguguguguacauauaauauauauauauauauauuauaaauaucaaagaaauu

SEQ ID NO: 756253 - RNA, 64 nt, hsa
guuaccagguguguguguacauauaauauauauauauauauauuauaaauaucaaagaaauuau

SEQ ID NO: 756254 - RNA, 64 nt, hsa
gauuguaagaaaacuuuaauuaaaaauuaaagacuauauauaauuaaacuacucugcccuggac

SEQ ID NO: 756255 - RNA, 64 nt, hsa
auaaauaaaaaaauaaauaaaaauaaaaauagacuauauauagucuuugaauucauuuauuuua

SEQ ID NO: 756256 - RNA, 64 nt, hsa
uuccuaaauaaaugaggaguagcauaguuuaaaauauauauaucuuauaacuuucuacaacaaa

SEQ ID NO: 756257 - RNA, 64 nt, hsa
uauauguauaucaaaacauguaguacacccuaaauauauauaauuuuuauuugucaaauauacc

SEQ ID NO: 756258 - RNA, 64 nt, hsa
ggggcgaaaaaccacaaaggaaaggaagaaaauuuauauauauauaauauaaaaucacuuggug

SEQ ID NO: 756259 - RNA, 64 nt, hsa
ggcgaaaaaccacaaaggaaaggaagaaaauuuauauauauauaauauaaaaucacuuggugau

SEQ ID NO: 756260 - RNA, 64 nt, hsa
cgaaaaaccacaaaggaaaggaagaaaauuuauauauauauaauauaaaaucacuuggugauua

SEQ ID NO: 756261 - RNA, 64 nt, hsa
uuaaaccaguguauuuuuuuagaacugguuuguguauauauauagugauuauggauacuaauuc

SEQ ID NO: 756262 - RNA, 64 nt, hsa
aaaccaguguauuuuuuuagaacugguuuguguauauauauagugauuauggauacuaauucaa

SEQ ID NO: 756263 - RNA, 64 nt, hsa
cuguuggaucuagaaggugaagaauuuuuuuauguauauauagacauaucuauauaaauugucu

SEQ ID NO: 756264 - RNA, 64 nt, hsa
aauuuuaaagauaaaauaggacauauuuugcagauauauauauauauauacacaaacacaucuc

SEQ ID NO: 756265 - RNA, 64 nt, hsa
uuuuaaagauaaaauaggacauauuuugcagauauauauauauauauacacaaacacaucucca

SEQ ID NO: 756266 - RNA, 64 nt, hsa
uuaaagauaaaauaggacauauuuugcagauauauauauauauauacacaaacacaucuccagg

SEQ ID NO: 756267 - RNA, 64 nt, hsa
aaagauaaaauaggacauauuuugcagauauauauauauauauacacaaacacaucuccaggua

SEQ ID NO: 756268 - RNA, 64 nt, hsa
agauaaaauaggacauauuuugcagauauauauauauauauacacaaacacaucuccagguaua

SEQ ID NO: 756269 - RNA, 64 nt, hsa
aaagaaaauauaauuuaacuuuaaagauguaaauuauauauauaguauauuauauauauuuuua

SEQ ID NO: 756270 - RNA, 64 nt, hsa
agaaaauauaauuuaacuuuaaagauguaaauuauauauauaguauauuauauauauuuuuaaa

SEQ ID NO: 756271 - RNA, 64 nt, hsa
aacuuuaaagauguaaauuauauauauaguauauuauauauauuuuuaaagcuuuauaugccuc

SEQ ID NO: 756272 - RNA, 64 nt, hsa
gcacaccuuuaaucucuauauggcagcauauacauauauauauauaaaaugcacacuuuuaauc

SEQ ID NO: 756273 - RNA, 64 nt, hsa
acaccuuuaaucucuauauggcagcauauacauauauauauauaaaaugcacacuuuuaaucuc

SEQ ID NO: 756274 - RNA, 64 nt, hsa
accuuuaaucucuauauggcagcauauacauauauauauauaaaaugcacacuuuuaaucucua

SEQ ID NO: 756275 - RNA, 64 nt, hsa
uuuuguaguguucuguauuuaucugcacuuuguguauauauacacacauacauaugccaacaug

SEQ ID NO: 756276 - RNA, 64 nt, hsa
auauuagagaauucuuuaaugcacacuugucaaauauauauauauaguaccaauguuaccuuuu

SEQ ID NO: 756277 - RNA, 64 nt, hsa
auuagagaauucuuuaaugcacacuugucaaauauauauauauaguaccaauguuaccuuuuua

SEQ ID NO: 756278 - RNA, 64 nt, hsa
uagagaauucuuuaaugcacacuugucaaauauauauauauaguaccaauguuaccuuuuuauu

SEQ ID NO: 756279 - RNA, 64 nt, hsa
ggcuaugcuuccuuugaugacauauauuauacaguauauauauacauauauuuuuuuuguuaga

SEQ ID NO: 756280 - RNA, 64 nt, hsa
cuaugcuuccuuugaugacauauauuauacaguauauauauacauauauuuuuuuuguuagagu

SEQ ID NO: 756281 - RNA, 64 nt, hsa
aaacuagucuuucugcuggaaucuaaggaguauauauauauaugcccccuugugguuaauuauu

SEQ ID NO: 756282 - RNA, 64 nt, hsa
uaaaacuagucuuucugcuggaaucuaaggaguauauauauauaugcccccuugugguuaauua

SEQ ID NO: 756283 - RNA, 64 nt, hsa
cuuaaaacuagucuuucugcuggaaucuaaggaguauauauauauaugcccccuugugguuaau

SEQ ID NO: 756284 - RNA, 64 nt, hsa
aaugugaaaucagauaguuguuuucauacauauauauauauacacacacacacacacacacaca

SEQ ID NO: 756285 - RNA, 64 nt, hsa
ucaaugugaaaucagauaguuguuuucauacauauauauauauacacacacacacacacacaca

SEQ ID NO: 756286 - RNA, 64 nt, hsa
guucaaugugaaaucagauaguuguuuucauacauauauauauauacacacacacacacacaca

SEQ ID NO: 756287 - RNA, 64 nt, hsa
uguguguauguauguguauauauauauauauauauauauauaaacaaguuuguugacaccuacu

SEQ ID NO: 756288 - RNA, 64 nt, hsa
uguguguguauguauguguauauauauauauauauauauauauaaacaaguuuguugacaccua

SEQ ID NO: 756289 - RNA, 64 nt, hsa
acuguguguguauguauguguauauauauauauauauauauauauauauauauaaacaaguuug

SEQ ID NO: 756290 - RNA, 64 nt, hsa
ugacuguguguguauguauguguauauauauauauauauauauauauauauauauaaacaaguu

SEQ ID NO: 756291 - RNA, 64 nt, hsa
ugugacuguguguguauguauguguauauauauauauauauauauauauauauauauaaacaag

SEQ ID NO: 756292 - RNA, 64 nt, hsa
aaugugacuguguguguauguauguguauauauauauauauauauauauauauauauauaaaca

SEQ ID NO: 756293 - RNA, 64 nt, hsa
ggaaugugacuguguguguauguauguguauauauauauauauauauauauauauauauauaaa

SEQ ID NO: 756294 - RNA, 64 nt, hsa
cuggaaugugacuguguguguauguauguguauauauauauauauauauauauauauauauaua

SEQ ID NO: 756295 - RNA, 64 nt, hsa
cacuggaaugugacuguguguguauguauguguauauauauauauauauauauauauauauaua

SEQ ID NO: 756296 - RNA, 64 nt, hsa
cacacuggaaugugacuguguguguauguauguguauauauauauauauauauauauauauaua

SEQ ID NO: 756297 - RNA, 64 nt, hsa
gguggaauaaagucacaugaaaacaaaacacaacuauauauauuuucaguuuuuuugccuuauu

SEQ ID NO: 756298 - RNA, 64 nt, hsa
caccucuggaauaauguguuaaauaucuguauauuauauauauguagagaaaaaucuaauuuuu

SEQ ID NO: 756299 - RNA, 64 nt, hsa
gcaaagucaacaguauuugccuuaagauuucauauauauauauuuuuuugcauugacugcugag

SEQ ID NO: 756300 - RNA, 64 nt, hsa
gugcaaagucaacaguauuugccuuaagauuucauauauauauauuuuuuugcauugacugcug

SEQ ID NO: 756301 - RNA, 64 nt, hsa
gaguagcaggccuuuguauguguguacauauauauauauauaacaaaacaucagccuugggugg

SEQ ID NO: 756302 - RNA, 64 nt, hsa
aagaguagcaggccuuuguauguguguacauauauauauauauaacaaaacaucagccuugggu

SEQ ID NO: 756303 - RNA, 64 nt, hsa
gaaagaguagcaggccuuuguauguguguacauauauauauauauaacaaaacaucagccuugg

SEQ ID NO: 756304 - RNA, 64 nt, hsa
aagaaagaguagcaggccuuuguauguguguacauauauauauauauaacaaaacaucagccuu

SEQ ID NO: 756305 - RNA, 64 nt, hsa
cuuuauauauuuuauauauauaaauauauauguauauauauaaugaucucuauuuuaaaacuag

SEQ ID NO: 756306 - RNA, 64 nt, hsa
cucuuuauauauuuuauauauauaaauauauauguauauauauaaugaucucuauuuuaaaacu

SEQ ID NO: 756307 - RNA, 64 nt, hsa
gguggcacuucucaauuccucuuuauauauuuuauauauauaaauauauauguauauauauaau

SEQ ID NO: 756308 - RNA, 64 nt, hsa
gggguggcacuucucaauuccucuuuauauauuuuauauauauaaauauauauguauauauaua

SEQ ID NO: 756309 - RNA, 64 nt, hsa
uacugaauuauauauauauauacauauauauauauauauauaaaccaaaaguaguuggaaagau

SEQ ID NO: 756310 - RNA, 64 nt, hsa
ccuacugaauuauauauauauauacauauauauauauauauauaaaccaaaaguaguuggaaag

SEQ ID NO: 756311 - RNA, 64 nt, hsa
ugccuacugaauuauauauauauauacauauauauauauauauauaaaccaaaaguaguuggaa

SEQ ID NO: 756312 - RNA, 64 nt, hsa
agugccuacugaauuauauauauauauacauauauauauauauauauaaaccaaaaguaguugg

SEQ ID NO: 756313 - RNA, 64 nt, hsa
uuagugccuacugaauuauauauauauauacauauauauauauauauauaaaccaaaaguaguu

SEQ ID NO: 756314 - RNA, 64 nt, hsa
uuuuagugccuacugaauuauauauauauauacauauauauauauauauauaaaccaaaaguag

SEQ ID NO: 756315 - RNA, 64 nt, hsa
cugcauggguuuuuagugccuacugaauuauauauauauauacauauauauauauauauauaaa

SEQ ID NO: 756316 - RNA, 64 nt, hsa
agcugcauggguuuuuagugccuacugaauuauauauauauauacauauauauauauauauaua

SEQ ID NO: 756317 - RNA, 64 nt, hsa
gcagcugcauggguuuuuagugccuacugaauuauauauauauauacauauauauauauauaua

SEQ ID NO: 756318 - RNA, 64 nt, hsa
augcagcugcauggguuuuuagugccuacugaauuauauauauauauacauauauauauauaua

SEQ ID NO: 756319 - RNA, 64 nt, hsa
uauguuuagaacuuuauaucuugggacuuauguauauauauaccuuuuaaauaaaauaaauuuu

SEQ ID NO: 756320 - RNA, 64 nt, hsa
ucuauguuuagaacuuuauaucuugggacuuauguauauauauaccuuuuaaauaaaauaaauu

SEQ ID NO: 756321 - RNA, 64 nt, hsa
gauccaagucuaaacacaaaauucauuuauauuuuauauauaccuuguucacauacccugaagg

SEQ ID NO: 756322 - RNA, 64 nt, hsa
aaaaaaaaaaaaccagcauacauaugcaaaacuauauauauauguauauguagagaaaaauacu

SEQ ID NO: 756323 - RNA, 64 nt, hsa
aaaaaaaaaaaaaaccagcauacauaugcaaaacuauauauauauguauauguagagaaaaaua

SEQ ID NO: 756324 - RNA, 64 nt, hsa
ggaaagauggcaucaaaaaagauagaucuauauauauauauaaauauauauucuauuacauuuu

SEQ ID NO: 756325 - RNA, 64 nt, hsa
auggaaagauggcaucaaaaaagauagaucuauauauauauauaaauauauauucuauuacauu

SEQ ID NO: 756326 - RNA, 64 nt, hsa
cuauggaaagauggcaucaaaaaagauagaucuauauauauauauaaauauauauucuauuaca

SEQ ID NO: 756327 - RNA, 64 nt, hsa
cccuauggaaagauggcaucaaaaaagauagaucuauauauauauauaaauauauauucuauua

SEQ ID NO: 756328 - RNA, 64 nt, hsa
auauauuauauauauaauauauauauaaaauauauauauauaugcucuccucuuucagccucuu

SEQ ID NO: 756329 - RNA, 64 nt, hsa
auauauauuauauauauaauauauauauaaaauauauauauauaugcucuccucuuucagccuc

SEQ ID NO: 756330 - RNA, 64 nt, hsa
auauauauauuauauauauaauauauauauaaaauauauauauauaugcucuccucuuucagcc

SEQ ID NO: 756331 - RNA, 64 nt, hsa
uauaauauauuauauauauauuauauauauaauauauauauaaaauauauauauauaugcucuc

SEQ ID NO: 756332 - RNA, 64 nt, hsa
aauauaauauauuauauauauauuauauauauaauauauauauaaaauauauauauauaugcuc

SEQ ID NO: 756333 - RNA, 64 nt, hsa
auaauauauaauauaauauauuauauauauauuauauauauaauauauauauaaaauauauaua

SEQ ID NO: 756334 - RNA, 64 nt, hsa
auauaauauauaauauaauauauuauauauauauuauauauauaauauauauauaaaauauaua

SEQ ID NO: 756335 - RNA, 64 nt, hsa
auauuauauauauaauauauaauauaauauauuauauauauauuauauauauaauauauauaua

SEQ ID NO: 756336 - RNA, 64 nt, hsa
auauauuauauauauaauauauaauauaauauauuauauauauauuauauauauaauauauaua

SEQ ID NO: 756337 - RNA, 64 nt, hsa
auauauaauauaauauauguguauauauauauuauauauauaauauauaauauaauauauuaua

SEQ ID NO: 756338 - RNA, 64 nt, hsa
auauauauaauauaauauauguguauauauauauuauauauauaauauauaauauaauauauua

SEQ ID NO: 756339 - RNA, 64 nt, hsa
uauguguguauauauauaauauaauauauguguauauauauauuauauauauaauauauaauau

SEQ ID NO: 756340 - RNA, 64 nt, hsa
uauauguguguauauauauaauauaauauauguguauauauauauuauauauauaauauauaau

SEQ ID NO: 756341 - RNA, 64 nt, hsa
uuguuucuccauauauauauuauauauguguguauauauauaauauaauauauguguauauaua

SEQ ID NO: 756342 - RNA, 64 nt, hsa
gauuguuucuccauauauauauuauauauguguguauauauauaauauaauauauguguauaua

SEQ ID NO: 756343 - RNA, 64 nt, hsa
uuuauauugugcuauaaaaaggauuguuucuccauauauauauuauauauguguguauauauau

SEQ ID NO: 756344 - RNA, 64 nt, hsa
gaauucuauugaguggcagugucauugagcaguauauauauaaagcacagauuugcauuucaga

SEQ ID NO: 756345 - RNA, 64 nt, hsa
aggaauucuauugaguggcagugucauugagcaguauauauauaaagcacagauuugcauuuca

SEQ ID NO: 756346 - RNA, 64 nt, hsa
uuucuggguucauauauauauauauauauacauauauauauauuuuuuuuuggaugaagguugc

SEQ ID NO: 756347 - RNA, 64 nt, hsa
uuuuucuggguucauauauauauauauauauacauauauauauauuuuuuuuuggaugaagguu

SEQ ID NO: 756348 - RNA, 64 nt, hsa
aaauaaguuuuuuuucuggguucauauauauauauauauauacauauauauauauuuuuuuuug

SEQ ID NO: 756349 - RNA, 64 nt, hsa
guaaauaaguuuuuuuucuggguucauauauauauauauauauacauauauauauauuuuuuuu

SEQ ID NO: 756350 - RNA, 64 nt, hsa
uuguaaauaaguuuuuuuucuggguucauauauauauauauauauacauauauauauauuuuuu

SEQ ID NO: 756351 - RNA, 64 nt, hsa
cuuuguaaauaaguuuuuuuucuggguucauauauauauauauauauacauauauauauauuuu

SEQ ID NO: 756352 - RNA, 64 nt, hsa
aacuuuguaaauaaguuuuuuuucuggguucauauauauauauauauauacauauauauauauu

SEQ ID NO: 756353 - RNA, 64 nt, hsa
auaacuuuguaaauaaguuuuuuuucuggguucauauauauauauauauauacauauauauaua

SEQ ID NO: 756354 - RNA, 64 nt, hsa
uauauauguauguauauauauauaugaaaauauauauauauaugaaaaauaaagcuuaauuguc

SEQ ID NO: 756355 - RNA, 64 nt, hsa
uuuauauauguauguauauauauauaugaaaauauauauauauaugaaaaauaaagcuuaauug

SEQ ID NO: 756356 - RNA, 64 nt, hsa
ccuuuauauauguauguauauauauauaugaaaauauauauauauaugaaaaauaaagcuuaau

SEQ ID NO: 756357 - RNA, 64 nt, hsa
uuugcaaauuguuuccuuuauauauguauguauauauauauaugaaaauauauauauauaugaa

SEQ ID NO: 756358 - RNA, 64 nt, hsa
aauuugcaaauuguuuccuuuauauauguauguauauauauauaugaaaauauauauauauaug

SEQ ID NO: 756359 - RNA, 64 nt, hsa
uaaauuugcaaauuguuuccuuuauauauguauguauauauauauaugaaaauauauauauaua

SEQ ID NO: 756360 - RNA, 64 nt, hsa
uuacaggaaccauaguucuuggugacuacauauauauauauauuuuugugaccuuuuuuguaaa

SEQ ID NO: 756361 - RNA, 64 nt, hsa
uuuuacaggaaccauaguucuuggugacuacauauauauauauauuuuugugaccuuuuuugua

SEQ ID NO: 756362 - RNA, 64 nt, hsa
uauuuuacaggaaccauaguucuuggugacuacauauauauauauauuuuugugaccuuuuuug

SEQ ID NO: 756363 - RNA, 64 nt, hsa
uaaaaauccuagguagccuauuuuaauauuuaaauauauauauuugugaaagaacuuuuagaac

SEQ ID NO: 756364 - RNA, 64 nt, hsa
guaugccccuugccccuuccccacacuaauaauuuauauauauaaauaucuauaugacgcucuu

SEQ ID NO: 756365 - RNA, 64 nt, hsa
augccccuugccccuuccccacacuaauaauuuauauauauaaauaucuauaugacgcucuuaa

SEQ ID NO: 756366 - RNA, 64 nt, hsa
cugauguuguuuuccuauggaaauauauaucuauuauauauauauuuuuugcaaaucucacaaa

SEQ ID NO: 756367 - RNA, 64 nt, hsa
gauguuguuuuccuauggaaauauauaucuauuauauauauauuuuuugcaaaucucacaaagu

SEQ ID NO: 756368 - RNA, 64 nt, hsa
uagacuuuguguccauccccaagaucucucauuuuauauauauauauauauauauauauauaua

SEQ ID NO: 756369 - RNA, 64 nt, hsa
gacuuuguguccauccccaagaucucucauuuuauauauauauauauauauauauauauauaua

SEQ ID NO: 756370 - RNA, 64 nt, hsa
cuuuguguccauccccaagaucucucauuuuauauauauauauauauauauauauauauauaua

SEQ ID NO: 756371 - RNA, 64 nt, hsa
uuguguccauccccaagaucucucauuuuauauauauauauauauauauauauauauauauaua

SEQ ID NO: 756372 - RNA, 64 nt, hsa
guguccauccccaagaucucucauuuuauauauauauauauauauauauauauauauauauaua

SEQ ID NO: 756373 - RNA, 64 nt, hsa
guccauccccaagaucucucauuuuauauauauauauauauauauauauauauauauauauaua

SEQ ID NO: 756374 - RNA, 64 nt, hsa
ccauccccaagaucucucauuuuauauauauauauauauauauauauauauauauauauauaua

SEQ ID NO: 756375 - RNA, 64 nt, hsa
auccccaagaucucucauuuuauauauauauauauauauauauauauauauauauauauauaua

SEQ ID NO: 756376 - RNA, 64 nt, hsa
ccccaagaucucucauuuuauauauauauauauauauauauauauauauauauauauauauaua

SEQ ID NO: 756377 - RNA, 64 nt, hsa
ccaagaucucucauuuuauauauauauauauauauauauauauauauauauauauauauauaua

SEQ ID NO: 756378 - RNA, 64 nt, hsa
aagaucucucauuuuauauauauauauauauauauauauauauauauauauauauauauauaca

SEQ ID NO: 756379 - RNA, 64 nt, hsa
gaucucucauuuuauauauauauauauauauauauauauauauauauauauauauauauacaca

SEQ ID NO: 756380 - RNA, 64 nt, hsa
ucucucauuuuauauauauauauauauauauauauauauauauauauauauauauauacacaca

SEQ ID NO: 756381 - RNA, 64 nt, hsa
ucucauuuuauauauauauauauauauauauauauauauauauauauauauauauacacacaca

SEQ ID NO: 756382 - RNA, 64 nt, hsa
ucauuuuauauauauauauauauauauauauauauauauauauauauauauauacacacacaca

SEQ ID NO: 756383 - RNA, 64 nt, hsa
auuuuauauauauauauauauauauauauauauauauauauauauauauauacacacacacaca

SEQ ID NO: 756384 - RNA, 64 nt, hsa
uuuauauauauauauauauauauauauauauauauauauauauauauauacacacacacacaca

SEQ ID NO: 756385 - RNA, 64 nt, hsa
uauauauauauauauauauauauauauauauauauauauauauauauacacacacacacacaua

SEQ ID NO: 756386 - RNA, 64 nt, hsa
uauauauauauauauauauauauauauauauauauauauauauauacacacacacacacauaca

SEQ ID NO: 756387 - RNA, 64 nt, hsa
uauauauauauauauauauauauauauauauauauauauauauacacacacacacacauacaca

SEQ ID NO: 756388 - RNA, 64 nt, hsa
uauauauauauauauauauauauauauauauauauauauauacacacacacacacauacacaaa

SEQ ID NO: 756389 - RNA, 64 nt, hsa
ccagauuucgauguuucuuaagucuaggugaauuuauauauauauuuuuuugcuuuucauuuuc

SEQ ID NO: 756390 - RNA, 64 nt, hsa
agauuucgauguuucuuaagucuaggugaauuuauauauauauuuuuuugcuuuucauuuucua

SEQ ID NO: 756391 - RNA, 64 nt, hsa
gugcuuuuguuucacacuugauuuguaaaaauuuuauauauauguauuuaaaaugugccauuuu

SEQ ID NO: 756392 - RNA, 64 nt, hsa
cuggcuccacaauuuaguaacauuuauauuaagauauauauauaguggucacugugauauaaua

SEQ ID NO: 756393 - RNA, 64 nt, hsa
ggcuccacaauuuaguaacauuuauauuaagauauauauauaguggucacugugauauaauaaa

SEQ ID NO: 756394 - RNA, 64 nt, hsa
uguaauguuacagagagugugauuugguuugugauauauauauauugugcucuacuuuucucuu

SEQ ID NO: 756395 - RNA, 64 nt, hsa
uaauguuacagagagugugauuugguuugugauauauauauauugugcucuacuuuucucuuua

SEQ ID NO: 756396 - RNA, 64 nt, hsa
uuuuuaaaugcuggaggauuccaaucaauauaaauauauauauauauauacacacacauauaua

SEQ ID NO: 756397 - RNA, 64 nt, hsa
uuuaaaugcuggaggauuccaaucaauauaaauauauauauauauauacacacacauauauaaa

SEQ ID NO: 756398 - RNA, 64 nt, hsa
uaaaugcuggaggauuccaaucaauauaaauauauauauauauauacacacacauauauaaaaa

SEQ ID NO: 756399 - RNA, 64 nt, hsa
aaugcuggaggauuccaaucaauauaaauauauauauauauauacacacacauauauaaaaagu

SEQ ID NO: 756400 - RNA, 64 nt, hsa
ugcuggaggauuccaaucaauauaaauauauauauauauauacacacacauauauaaaaaguau

SEQ ID NO: 756401 - RNA, 64 nt, hsa
gagaguguguguguguguauguguguguaauauuuauauauauucacaguauguauuuagcauu

SEQ ID NO: 756402 - RNA, 64 nt, hsa
acugggguuaagucucugguauuuaggcuggcaauauauauauuaaccauauuuuaaaaguacc

SEQ ID NO: 756403 - RNA, 64 nt, hsa
auccaccucugccuaaguaaaucugcucucaaccuauauauauacaaggucauucauucuagca

SEQ ID NO: 756404 - RNA, 64 nt, hsa
ccaccucugccuaaguaaaucugcucucaaccuauauauauacaaggucauucauucuagcauu

SEQ ID NO: 756405 - RNA, 64 nt, hsa
aauacuuuuuaacaaaaaacagauucuauauuauuauauauauauauauauauauaaagauaua

SEQ ID NO: 756406 - RNA, 64 nt, hsa
uacuuuuuaacaaaaaacagauucuauauuauuauauauauauauauauauauaaagauauaua

SEQ ID NO: 756407 - RNA, 64 nt, hsa
cuuuuuaacaaaaaacagauucuauauuauuauauauauauauauauauauaaagauauauaga

SEQ ID NO: 756408 - RNA, 64 nt, hsa
uuuuaacaaaaaacagauucuauauuauuauauauauauauauauauauaaagauauauagaga

SEQ ID NO: 756409 - RNA, 64 nt, hsa
uuaacaaaaaacagauucuauauuauuauauauauauauauauauauaaagauauauagagaug

SEQ ID NO: 756410 - RNA, 64 nt, hsa
aacaaaaaacagauucuauauuauuauauauauauauauauauauaaagauauauagagaugca

SEQ ID NO: 756411 - RNA, 64 nt, hsa
caaaaaacagauucuauauuauuauauauauauauauauauauaaagauauauagagaugcauu

SEQ ID NO: 756412 - RNA, 64 nt, hsa
aaaaacagauucuauauuauuauauauauauauauauauauaaagauauauagagaugcauuca

SEQ ID NO: 756413 - RNA, 64 nt, hsa
cacacacaaauugacucuuauuuauagaauuuaauauauauauauauauauauauauauagguu

SEQ ID NO: 756414 - RNA, 64 nt, hsa
cacacaaauugacucuuauuuauagaauuuaauauauauauauauauauauauauauagguucu

SEQ ID NO: 756415 - RNA, 64 nt, hsa
cacaaauugacucuuauuuauagaauuuaauauauauauauauauauauauauauagguucuuu

SEQ ID NO: 756416 - RNA, 64 nt, hsa
caaauugacucuuauuuauagaauuuaauauauauauauauauauauauauauagguucuuuuc

SEQ ID NO: 756417 - RNA, 64 nt, hsa
aauugacucuuauuuauagaauuuaauauauauauauauauauauauauauagguucuuuucuc

SEQ ID NO: 756418 - RNA, 64 nt, hsa
uugacucuuauuuauagaauuuaauauauauauauauauauauauauauagguucuuuucucuc

SEQ ID NO: 756419 - RNA, 64 nt, hsa
gacucuuauuuauagaauuuaauauauauauauauauauauauauauagguucuuuucucucuu

SEQ ID NO: 756420 - RNA, 64 nt, hsa
cucuuauuuauagaauuuaauauauauauauauauauauauauauagguucuuuucucucuucc

SEQ ID NO: 756421 - RNA, 64 nt, hsa
cuuauuuauagaauuuaauauauauauauauauauauauauauagguucuuuucucucuuccuc

SEQ ID NO: 756422 - RNA, 64 nt, hsa
uauuuauagaauuuaauauauauauauauauauauauauauagguucuuuucucucuuccucuc

SEQ ID NO: 756423 - RNA, 64 nt, hsa
gaaugguuuuaggcuccaguguuauacuuuuuuuuauauauauauauaaaaauaaacuuuacgu

SEQ ID NO: 756424 - RNA, 64 nt, hsa
augguuuuaggcuccaguguuauacuuuuuuuuauauauauauauaaaaauaaacuuuacguag

SEQ ID NO: 756425 - RNA, 64 nt, hsa
gguuuuaggcuccaguguuauacuuuuuuuuauauauauauauaaaaauaaacuuuacguagug

SEQ ID NO: 756426 - RNA, 64 nt, hsa
uuuuaggcuccaguguuauacuuuuuuuuauauauauauauaaaaauaaacuuuacguagugaa

SEQ ID NO: 756427 - RNA, 64 nt, hsa
uguguguguauauauguauguguguauguguguguauauauagauguauauauauacacacaca

SEQ ID NO: 756428 - RNA, 64 nt, hsa
uauguauguguguauguguguguauauauagauguauauauauacacacacagagauauauaca

SEQ ID NO: 756429 - RNA, 64 nt, hsa
uguauguguguauguguguguauauauagauguauauauauacacacacagagauauauacaua

SEQ ID NO: 756430 - RNA, 64 nt, hsa
uuaugucucagaugcuaacgugugaaaauauaaauauauauaauauauaaaguaaccagucuuc

SEQ ID NO: 756431 - RNA, 64 nt, hsa
ggccaauggaacaguaagaacaucauaaaauuuuuauauauauaguuuauuuuugugggagaua

SEQ ID NO: 756432 - RNA, 64 nt, hsa
ccaauggaacaguaagaacaucauaaaauuuuuauauauauaguuuauuuuugugggagauaaa

SEQ ID NO: 756433 - RNA, 64 nt, hsa
acagagcaagacacugucucucucucucucuccauauauauauguguguguguguauauauaua

SEQ ID NO: 756434 - RNA, 64 nt, hsa
ucucucucucuccauauauauauguguguguguguauauauauauauaugugugugugugugug

SEQ ID NO: 756435 - RNA, 64 nt, hsa
ucucucucuccauauauauauguguguguguguauauauauauauaugugugugugugugugug

SEQ ID NO: 756436 - RNA, 64 nt, hsa
ucucucuccauauauauauguguguguguguauauauauauauaugugugugugugugugugua

SEQ ID NO: 756437 - RNA, 64 nt, hsa
ucucuccauauauauauguguguguguguauauauauauauauguguguguguguguguguaua

SEQ ID NO: 756438 - RNA, 64 nt, hsa
cacauauauacacacacacauacauauacauguguauauauauaccaucccauauauauguggg

SEQ ID NO: 756439 - RNA, 64 nt, hsa
cauauauacacacacacauacauauacauguguauauauauaccaucccauauauaugugggau

SEQ ID NO: 756440 - RNA, 64 nt, hsa
guguauauauauaccaucccauauauaugugggauauauauauauauauauauggauaugguua

SEQ ID NO: 756441 - RNA, 64 nt, hsa
guauauauauaccaucccauauauaugugggauauauauauauauauauauggauaugguuaua

SEQ ID NO: 756442 - RNA, 64 nt, hsa
auauauauaccaucccauauauaugugggauauauauauauauauauauggauaugguuauaua

SEQ ID NO: 756443 - RNA, 64 nt, hsa
auauauaccaucccauauauaugugggauauauauauauauauauauggauaugguuauauaua

SEQ ID NO: 756444 - RNA, 64 nt, hsa
auauaccaucccauauauaugugggauauauauauauauauauauggauaugguuauauauaug

SEQ ID NO: 756445 - RNA, 64 nt, hsa
auaccaucccauauauaugugggauauauauauauauauauauggauaugguuauauauauggg

SEQ ID NO: 756446 - RNA, 64 nt, hsa
gugggauauauauauauauauauauggauaugguuauauauaugggaugguuugguugguccca

SEQ ID NO: 756447 - RNA, 64 nt, hsa
auugauugaggguagcuuguugcaaugcuuaacuuauauauacauauauauauauuauaaauau

SEQ ID NO: 756448 - RNA, 64 nt, hsa
gguagcuuguugcaaugcuuaacuuauauauacauauauauauauuauaaauauugcucaucaa

SEQ ID NO: 756449 - RNA, 64 nt, hsa
uagcuuguugcaaugcuuaacuuauauauacauauauauauauuauaaauauugcucaucaaaa

SEQ ID NO: 756450 - RNA, 64 nt, hsa
cuaguaaaucacagugguucaaaauauauauccauauauauauauauccauauauauaucucau

SEQ ID NO: 756451 - RNA, 64 nt, hsa
aguaaaucacagugguucaaaauauauauccauauauauauauauccauauauauaucucaugu

SEQ ID NO: 756452 - RNA, 64 nt, hsa
uaaaucacagugguucaaaauauauauccauauauauauauauccauauauauaucucauguca

SEQ ID NO: 756453 - RNA, 64 nt, hsa
guucaaaauauauauccauauauauauauauccauauauauaucucaugucaucacauuacagg

SEQ ID NO: 756454 - RNA, 64 nt, hsa
auucauaaugauaaaauaauaaaaugcgaauuacuauauauaaugugccucacucaugagaaag

SEQ ID NO: 756455 - RNA, 64 nt, hsa
caguggcuaaaguugaaaagggguugguuuccuguauauauauguauguauauacacacguaca

SEQ ID NO: 756456 - RNA, 64 nt, hsa
uauauguauguauauacacacguacauacauucauauauauacauauauacauaaugugcuuaa

SEQ ID NO: 756457 - RNA, 64 nt, hsa
agaaccaauuguuguacauaaaacagauugcgcauauauauauauguauaaaaaauaauaaaau

SEQ ID NO: 756458 - RNA, 64 nt, hsa
aaccaauuguuguacauaaaacagauugcgcauauauauauauguauaaaaaauaauaaaauaa

SEQ ID NO: 756459 - RNA, 64 nt, hsa
aaaguuuuaguuuuuuaagaaguacucaugcagauauauauauauauauuuuucccaguccuuu

SEQ ID NO: 756460 - RNA, 64 nt, hsa
aguuuuaguuuuuuaagaaguacucaugcagauauauauauauauauuuuucccaguccuuuuu

SEQ ID NO: 756461 - RNA, 64 nt, hsa
uuuuaguuuuuuaagaaguacucaugcagauauauauauauauauuuuucccaguccuuuuuuu

SEQ ID NO: 756462 - RNA, 64 nt, hsa
uuaguuuuuuaagaaguacucaugcagauauauauauauauauuuuucccaguccuuuuuuuaa

SEQ ID NO: 756463 - RNA, 64 nt, hsa
auuucagccaaauaaaugggccaagggaaaaaaauauauauauauagacaggacuagagaaaac

SEQ ID NO: 756464 - RNA, 64 nt, hsa
uucagccaaauaaaugggccaagggaaaaaaauauauauauauagacaggacuagagaaaaccu

SEQ ID NO: 756465 - RNA, 64 nt, hsa
cagccaaauaaaugggccaagggaaaaaaauauauauauauagacaggacuagagaaaaccuau

SEQ ID NO: 756466 - RNA, 64 nt, hsa
uugauauggccaaagggagagaggccuuuuaaaauauauauauauauacacauauauauguaua

SEQ ID NO: 756467 - RNA, 64 nt, hsa
gauauggccaaagggagagaggccuuuuaaaauauauauauauauacacauauauauguauaua

SEQ ID NO: 756468 - RNA, 64 nt, hsa
uauggccaaagggagagaggccuuuuaaaauauauauauauauacacauauauauguauauaua

SEQ ID NO: 756469 - RNA, 64 nt, hsa
uggccaaagggagagaggccuuuuaaaauauauauauauauacacauauauauguauauauaca

SEQ ID NO: 756470 - RNA, 64 nt, hsa
uuuuaaaauauauauauauauacacauauauauguauauauacacauauauguauguauacaca

SEQ ID NO: 756471 - RNA, 64 nt, hsa
uacacauauauguauguauacacauauacacauguauauauacauguguguauguauacaugua

SEQ ID NO: 756472 - RNA, 64 nt, hsa
cacauguauauauacauguguguauguauacauguauauauauauacauacacauauauguaua

SEQ ID NO: 756473 - RNA, 64 nt, hsa
cauguauauauacauguguguauguauacauguauauauauauacauacacauauauguauaca

SEQ ID NO: 756474 - RNA, 64 nt, hsa
uguauauauacauguguguauguauacauguauauauauauacauacacauauauguauacaua

SEQ ID NO: 756475 - RNA, 64 nt, hsa
cauauauguauacauauauacacauauguauacauauauauauauucuacaguaaaacuguaga

SEQ ID NO: 756476 - RNA, 64 nt, hsa
uauauguauacauauauacacauauguauacauauauauauauucuacaguaaaacuguagacu

SEQ ID NO: 756477 - RNA, 64 nt, hsa
ucaugaugggucacauauagacauauguacauauuauauauauauauauauauauauauauaua

SEQ ID NO: 756478 - RNA, 64 nt, hsa
augaugggucacauauagacauauguacauauuauauauauauauauauauauauauauauaua

SEQ ID NO: 756479 - RNA, 64 nt, hsa
gaugggucacauauagacauauguacauauuauauauauauauauauauauauauauauauaua

SEQ ID NO: 756480 - RNA, 64 nt, hsa
ugggucacauauagacauauguacauauuauauauauauauauauauauauauauauauauaua

SEQ ID NO: 756481 - RNA, 64 nt, hsa
ggucacauauagacauauguacauauuauauauauauauauauauauauauauauauauauaua

SEQ ID NO: 756482 - RNA, 64 nt, hsa
ucacauauagacauauguacauauuauauauauauauauauauauauauauauauauauauaua

SEQ ID NO: 756483 - RNA, 64 nt, hsa
acauauagacauauguacauauuauauauauauauauauauauauauauauauauauauauaua

SEQ ID NO: 756484 - RNA, 64 nt, hsa
auauagacauauguacauauuauauauauauauauauauauauauauauauauauauauauaua

SEQ ID NO: 756485 - RNA, 64 nt, hsa
auagacauauguacauauuauauauauauauauauauauauauauauauauauauauauauaua

SEQ ID NO: 756486 - RNA, 64 nt, hsa
agacauauguacauauuauauauauauauauauauauauauauauauauauauauauauauaua

SEQ ID NO: 756487 - RNA, 64 nt, hsa
acauauguacauauuauauauauauauauauauauauauauauauauauauauauauauauaag

SEQ ID NO: 756488 - RNA, 64 nt, hsa
auauguacauauuauauauauauauauauauauauauauauauauauauauauauauauaagcu

SEQ ID NO: 756489 - RNA, 64 nt, hsa
auguacauauuauauauauauauauauauauauauauauauauauauauauauauauaagcucu

SEQ ID NO: 756490 - RNA, 64 nt, hsa
guacauauuauauauauauauauauauauauauauauauauauauauauauauauaagcucuuu

SEQ ID NO: 756491 - RNA, 64 nt, hsa
acauauuauauauauauauauauauauauauauauauauauauauauauauauaagcucuuuuu

SEQ ID NO: 756492 - RNA, 64 nt, hsa
auauuauauauauauauauauauauauauauauauauauauauauauauauaagcucuuuuuuc

SEQ ID NO: 756493 - RNA, 64 nt, hsa
auuauauauauauauauauauauauauauauauauauauauauauauauaagcucuuuuuucug

SEQ ID NO: 756494 - RNA, 64 nt, hsa
uauauauauauauauauauauauauauauauauauauauauauauauaagcucuuuuuucugag

SEQ ID NO: 756495 - RNA, 64 nt, hsa
uauauauauauauauauauauauauauauauauauauauauauauaagcucuuuuuucugaggc

SEQ ID NO: 756496 - RNA, 64 nt, hsa
uauauauauauauauauauauauauauauauauauauauauauaagcucuuuuuucugaggcua

SEQ ID NO: 756497 - RNA, 64 nt, hsa
uauauauauauauauauauauauauauauauauauauauauaagcucuuuuuucugaggcuauu

SEQ ID NO: 756498 - RNA, 64 nt, hsa
acuuuauuuuuuaauguaacuuguucuaucuaucuauauauauauuugauaguuuguggaauaa

SEQ ID NO: 756499 - RNA, 64 nt, hsa
uuuauuuuuuaauguaacuuguucuaucuaucuauauauauauuugauaguuuguggaauaaua

SEQ ID NO: 756500 - RNA, 64 nt, hsa
agcaaaucguauaccuuauuaacaaaauagaauauauauauauugcuuaucugaaaugcuugaa

SEQ ID NO: 756501 - RNA, 64 nt, hsa
aaagcaaaucguauaccuuauuaacaaaauagaauauauauauauugcuuaucugaaaugcuug

SEQ ID NO: 756502 - RNA, 64 nt, hsa
cagggguauuauauauauacauauaagaugaugauauauauaaugaugauauguauuacugaga

SEQ ID NO: 756503 - RNA, 64 nt, hsa
acauguguacauauaucuauguacagggguauuauauauauacauauaagaugaugauauauau

SEQ ID NO: 756504 - RNA, 64 nt, hsa
auacauguguacauauaucuauguacagggguauuauauauauacauauaagaugaugauauau

SEQ ID NO: 756505 - RNA, 64 nt, hsa
ucagaugccggacacggauuuauauauaaauauauauauauaaauauauuauacucacucauca

SEQ ID NO: 756506 - RNA, 64 nt, hsa
agucagaugccggacacggauuuauauauaaauauauauauauaaauauauuauacucacucau

SEQ ID NO: 756507 - RNA, 64 nt, hsa
acagucagaugccggacacggauuuauauauaaauauauauauauaaauauauuauacucacuc

SEQ ID NO: 756508 - RNA, 64 nt, hsa
ccuaggugccacagucagaugccggacacggauuuauauauaaauauauauauauaaauauauu

SEQ ID NO: 756509 - RNA, 64 nt, hsa
auaugaguuucucccugccaaggcaaaaaauauauauauauaccuauauuuauauguguauguc

SEQ ID NO: 756510 - RNA, 64 nt, hsa
ugauaugaguuucucccugccaaggcaaaaaauauauauauauaccuauauuuauauguguaug

SEQ ID NO: 756511 - RNA, 64 nt, hsa
aaugauaugaguuucucccugccaaggcaaaaaauauauauauauaccuauauuuauaugugua

SEQ ID NO: 756512 - RNA, 64 nt, hsa
gcaaaaguccaucuuaagaaauauauauauauauuauauauauucuuaguucuaagauuuccuu

SEQ ID NO: 756513 - RNA, 64 nt, hsa
gugacaaaagcaaaaguccaucuuaagaaauauauauauauauuauauauauucuuaguucuaa

SEQ ID NO: 756514 - RNA, 64 nt, hsa
gggugacaaaagcaaaaguccaucuuaagaaauauauauauauauuauauauauucuuaguucu

SEQ ID NO: 756515 - RNA, 64 nt, hsa
cugggugacaaaagcaaaaguccaucuuaagaaauauauauauauauuauauauauucuuaguu

SEQ ID NO: 756516 - RNA, 64 nt, hsa
cucaucucuaugaaaaaauuugaauauacauauauauauauauguauauuuaaaaagugaauau

SEQ ID NO: 756517 - RNA, 64 nt, hsa
agcucaucucuaugaaaaaauuugaauauacauauauauauauauguauauuuaaaaagugaau

SEQ ID NO: 756518 - RNA, 64 nt, hsa
aaagcucaucucuaugaaaaaauuugaauauacauauauauauauauguauauuuaaaaaguga

SEQ ID NO: 756519 - RNA, 64 nt, hsa
uauauacauauauauauacacauacauauauauauauauauauguauguauaaaauuucacagg

SEQ ID NO: 756520 - RNA, 64 nt, hsa
uauauauacauauauauauacacauacauauauauauauauauauguauguauaaaauuucaca

SEQ ID NO: 756521 - RNA, 64 nt, hsa
uauauauauacauauauauauacacauacauauauauauauauauauguauguauaaaauuuca

SEQ ID NO: 756522 - RNA, 64 nt, hsa
cauauauauauacauauauauauacacauacauauauauauauauauauguauguauaaaauuu

SEQ ID NO: 756523 - RNA, 64 nt, hsa
uucauauauauauacauauauauauacacauacauauauauauauauauauguauguauaaaau

SEQ ID NO: 756524 - RNA, 64 nt, hsa
ucuaaccacagagaauuucauauauauauacauauauauauacacauacauauauauauauaua

SEQ ID NO: 756525 - RNA, 64 nt, hsa
uuucuaaccacagagaauuucauauauauauacauauauauauacacauacauauauauauaua

SEQ ID NO: 756526 - RNA, 64 nt, hsa
uuuaaauauguuucuaaccacagagaauuucauauauauauacauauauauauacacauacaua

SEQ ID NO: 756527 - RNA, 64 nt, hsa
aguuuaaauauguuucuaaccacagagaauuucauauauauauacauauauauauacacauaca

SEQ ID NO: 756528 - RNA, 64 nt, hsa
auauuuauauaaauuauauauauauacauauauauauauauaugcgccacauaaucaacagaaa

SEQ ID NO: 756529 - RNA, 64 nt, hsa
aaauauuuauauaaauuauauauauauacauauauauauauauaugcgccacauaaucaacaga

SEQ ID NO: 756530 - RNA, 64 nt, hsa
agaaauauuuauauaaauuauauauauauacauauauauauauauaugcgccacauaaucaaca

SEQ ID NO: 756531 - RNA, 64 nt, hsa
agagaaauauuuauauaaauuauauauauauacauauauauauauauaugcgccacauaaucaa

SEQ ID NO: 756532 - RNA, 64 nt, hsa
ccuuguacauagagaaauauuuauauaaauuauauauauauacauauauauauauauaugcgcc

SEQ ID NO: 756533 - RNA, 64 nt, hsa
uuccuuguacauagagaaauauuuauauaaauuauauauauauacauauauauauauauaugcg

SEQ ID NO: 756534 - RNA, 64 nt, hsa
uauuccuuguacauagagaaauauuuauauaaauuauauauauauacauauauauauauauaug

SEQ ID NO: 756535 - RNA, 64 nt, hsa
agcuugcccagauacauaccuaaauauauauauauauauauaugagggagaacgccucacccag

SEQ ID NO: 756536 - RNA, 64 nt, hsa
ucagcuugcccagauacauaccuaaauauauauauauauauauaugagggagaacgccucaccc

SEQ ID NO: 756537 - RNA, 64 nt, hsa
ccucagcuugcccagauacauaccuaaauauauauauauauauauaugagggagaacgccucac

SEQ ID NO: 756538 - RNA, 64 nt, hsa
ggccucagcuugcccagauacauaccuaaauauauauauauauauauaugagggagaacgccuc

SEQ ID NO: 756539 - RNA, 64 nt, hsa
ugggccucagcuugcccagauacauaccuaaauauauauauauauauauaugagggagaacgcc

SEQ ID NO: 756540 - RNA, 64 nt, hsa
ccugggccucagcuugcccagauacauaccuaaauauauauauauauauauaugagggagaacg

SEQ ID NO: 756541 - RNA, 64 nt, hsa
uuuuucucugaaguccuguggacuugcaaauauauauauauauugcuuuguuaauuuguuuuua

SEQ ID NO: 756542 - RNA, 64 nt, hsa
uuuuuuucucugaaguccuguggacuugcaaauauauauauauauugcuuuguuaauuuguuuu

SEQ ID NO: 756543 - RNA, 64 nt, hsa
ccuuuuuuucucugaaguccuguggacuugcaaauauauauauauauugcuuuguuaauuuguu

SEQ ID NO: 756544 - RNA, 64 nt, hsa
auguucuauagaaaagaaaaaaaaaauauauauauauauauaucuuagucccugccucucaaga

SEQ ID NO: 756545 - RNA, 64 nt, hsa
uaauguucuauagaaaagaaaaaaaaaauauauauauauauauaucuuagucccugccucucaa

SEQ ID NO: 756546 - RNA, 64 nt, hsa
aauaauguucuauagaaaagaaaaaaaaaauauauauauauauauaucuuagucccugccucuc

SEQ ID NO: 756547 - RNA, 64 nt, hsa
ucaauaauguucuauagaaaagaaaaaaaaaauauauauauauauauaucuuagucccugccuc

SEQ ID NO: 756548 - RNA, 64 nt, hsa
uaucaauaauguucuauagaaaagaaaaaaaaaauauauauauauauauaucuuagucccugcc

SEQ ID NO: 756549 - RNA, 64 nt, hsa
aguaaaaauaacuauguuuugagauauguauguguauauauaaaagaaacaaagguuuuuaaug

SEQ ID NO: 756550 - RNA, 64 nt, hsa
aauauguauguccgaagggaaaaagcugcaaggauauauauaagaccacugcuuaucuguaucu

SEQ ID NO: 756551 - RNA, 64 nt, hsa
uguaagucaaaauugaaaugaaugcacauagauuuauauauaaauuagcaccugagcuaagguu

SEQ ID NO: 756552 - RNA, 64 nt, hsa
cuauaaauuguguacaguuaaaaaaauauauauauauauauauucuuacaugaguaaaaagcac

SEQ ID NO: 756553 - RNA, 64 nt, hsa
uacuauaaauuguguacaguuaaaaaaauauauauauauauauauucuuacaugaguaaaaagc

SEQ ID NO: 756554 - RNA, 64 nt, hsa
uguacuauaaauuguguacaguuaaaaaaauauauauauauauauauucuuacaugaguaaaaa

SEQ ID NO: 756555 - RNA, 64 nt, hsa
cauguacuauaaauuguguacaguuaaaaaaauauauauauauauauauucuuacaugaguaaa

SEQ ID NO: 756556 - RNA, 64 nt, hsa
cucauguacuauaaauuguguacaguuaaaaaaauauauauauauauauauucuuacaugagua

SEQ ID NO: 756557 - RNA, 64 nt, hsa
gugagucauauauauacauauauauauauacacauauauauaugacuugaaaauuaagauuuaa

SEQ ID NO: 756558 - RNA, 64 nt, hsa
uucauugguuuugugagucauauauauacauauauauauauacacauauauauaugacuugaaa

SEQ ID NO: 756559 - RNA, 64 nt, hsa
auuucauugguuuugugagucauauauauacauauauauauauacacauauauauaugacuuga

SEQ ID NO: 756560 - RNA, 64 nt, hsa
uuauuucauugguuuugugagucauauauauacauauauauauauacacauauauauaugacuu

SEQ ID NO: 756561 - RNA, 64 nt, hsa
aguaugauacuuauuucauugguuuugugagucauauauauacauauauauauauacacauaua

SEQ ID NO: 756562 - RNA, 64 nt, hsa
gguguucaaagacaucucccucagugcggauuuauauauauauuuuuccuucacugugucaagu

SEQ ID NO: 756563 - RNA, 64 nt, hsa
gagguguucaaagacaucucccucagugcggauuuauauauauauuuuuccuucacugugucaa

SEQ ID NO: 756564 - RNA, 64 nt, hsa
acagacaccccaaugcuauuuacauacagcucuauauauauaaaaaaagaaaauaugaauauua

SEQ ID NO: 756565 - RNA, 64 nt, hsa
aaacagacaccccaaugcuauuuacauacagcucuauauauauaaaaaaagaaaauaugaauau

SEQ ID NO: 756566 - RNA, 64 nt, hsa
acaagggcacgguuuuuauacauacguacauauauauauauaaacacacacauagauauauaug

SEQ ID NO: 756567 - RNA, 64 nt, hsa
gaacaagggcacgguuuuuauacauacguacauauauauauauaaacacacacauagauauaua

SEQ ID NO: 756568 - RNA, 64 nt, hsa
gugaacaagggcacgguuuuuauacauacguacauauauauauauaaacacacacauagauaua

SEQ ID NO: 756569 - RNA, 64 nt, hsa
ggcuuucugcaucacccaaucaauaaaaaacaaauauauauauguauauauauguauguaugug

SEQ ID NO: 756570 - RNA, 64 nt, hsa
aucacccaaucaauaaaaaacaaauauauauauguauauauauguauguauguguguguguaua

SEQ ID NO: 756571 - RNA, 64 nt, hsa
uauauauguauauauauguauguauguguguguguauauauauauauauauauauauauauaaa

SEQ ID NO: 756572 - RNA, 64 nt, hsa
uauauguauauauauguauguauguguguguguauauauauauauauauauauauauauaaaug

SEQ ID NO: 756573 - RNA, 64 nt, hsa
uauguauauauauguauguauguguguguguauauauauauauauauauauauauauaaaugau

SEQ ID NO: 756574 - RNA, 64 nt, hsa
uguauauauauguauguauguguguguguauauauauauauauauauauauauauaaaugauug

SEQ ID NO: 756575 - RNA, 64 nt, hsa
uauauauauguauguauguguguguguauauauauauauauauauauauauauaaaugauugua

SEQ ID NO: 756576 - RNA, 64 nt, hsa
uauauauguauguauguguguguguauauauauauauauauauauauauauaaaugauuguaag

SEQ ID NO: 756577 - RNA, 64 nt, hsa
uauauguauguauguguguguguauauauauauauauauauauauauauaaaugauuguaaguu

SEQ ID NO: 756578 - RNA, 64 nt, hsa
uauguauguauguguguguguauauauauauauauauauauauauauaaaugauuguaaguuga

SEQ ID NO: 756579 - RNA, 64 nt, hsa
uguauguauguguguguguauauauauauauauauauauauauauaaaugauuguaaguugaaa

SEQ ID NO: 756580 - RNA, 64 nt, hsa
uauguauguguguguguauauauauauauauauauauauauauaaaugauuguaaguugaaaac

SEQ ID NO: 756581 - RNA, 62 nt, hsa
uguauguguguguguauauauauauauauauauauauauauaaaugauuguaaguugaaaac

SEQ ID NO: 756582 - RNA, 64 nt, hsa
ccaaaaaaaaaaaaaaaaaaaaaaaaaaaaaaaauauauauauauauauacacacacacacaca

SEQ ID NO: 756583 - RNA, 64 nt, hsa
aaaaaaaaaaaaaaaaaaaaaaaaaaaaaaaauauauauauauauauacacacacacacacaca

SEQ ID NO: 756584 - RNA, 64 nt, hsa
aaaaaaaaaaaaaaaaaaaaaaaaaaaaaauauauauauauauauacacacacacacacacaua

SEQ ID NO: 756585 - RNA, 64 nt, hsa
aaaaaaaaaaaaaaaaaaaaaaaaaaaauauauauauauauauacacacacacacacacauaug

SEQ ID NO: 756586 - RNA, 64 nt, hsa
aaaaaaaaaaaaaaaaaaaaaaaaaauauauauauauauauacacacacacacacacauaugua

SEQ ID NO: 756587 - RNA, 64 nt, hsa
uauacacacacacacacacauauguacacauacauauauauacauauauauguauauauagaac

SEQ ID NO: 756588 - RNA, 64 nt, hsa
cauauguacacauacauauauauacauauauauguauauauagaacacauggcaagagcaggaa

SEQ ID NO: 756589 - RNA, 64 nt, hsa
ccccucccaguaauaaaaaaaaaaaaaaaaaaaauauauauauauauauauauauauauauaua

SEQ ID NO: 756590 - RNA, 64 nt, hsa
ccucccaguaauaaaaaaaaaaaaaaaaaaaauauauauauauauauauauauauauauauaua

SEQ ID NO: 756591 - RNA, 64 nt, hsa
ucccaguaauaaaaaaaaaaaaaaaaaaaauauauauauauauauauauauauauauauauaua

SEQ ID NO: 756592 - RNA, 64 nt, hsa
ccaguaauaaaaaaaaaaaaaaaaaaaauauauauauauauauauauauauauauauauauaua

SEQ ID NO: 756593 - RNA, 64 nt, hsa
aguaauaaaaaaaaaaaaaaaaaaaauauauauauauauauauauauauauauauauauauaua

SEQ ID NO: 756594 - RNA, 64 nt, hsa
uaauaaaaaaaaaaaaaaaaaaaauauauauauauauauauauauauauauauauauauauaua

SEQ ID NO: 756595 - RNA, 64 nt, hsa
auaaaaaaaaaaaaaaaaaaaauauauauauauauauauauauauauauauauauauauauaua

SEQ ID NO: 756596 - RNA, 64 nt, hsa
aaaaaaaaaaaaaaaaaaaauauauauauauauauauauauauauauauauauauauauauaua

SEQ ID NO: 756597 - RNA, 64 nt, hsa
aaaaaaaaaaaaaaaaaauauauauauauauauauauauauauauauauauauauauauauaua

SEQ ID NO: 756598 - RNA, 64 nt, hsa
aaaaaaaaaaaaaaaauauauauauauauauauauauauauauauauauauauauauauauaua

SEQ ID NO: 756599 - RNA, 64 nt, hsa
aaaaaaaaaaaaaauauauauauauauauauauauauauauauauauauauauauauauauaua

SEQ ID NO: 756600 - RNA, 64 nt, hsa
aaaaaaaaaaaauauauauauauauauauauauauauauauauauauauauauauauauauaua

SEQ ID NO: 756601 - RNA, 64 nt, hsa
aaaaaaaaaauauauauauauauauauauauauauauauauauauauauauauauauauauaua

SEQ ID NO: 756602 - RNA, 64 nt, hsa
aaaaaaaauauauauauauauauauauauauauauauauauauauauauauauauauauauaua

SEQ ID NO: 756603 - RNA, 64 nt, hsa
aaaaaauauauauauauauauauauauauauauauauauauauauauauauauauauauauagu

SEQ ID NO: 756604 - RNA, 64 nt, hsa
aaaauauauauauauauauauauauauauauauauauauauauauauauauauauauauaguuu

SEQ ID NO: 756605 - RNA, 64 nt, hsa
aauauauauauauauauauauauauauauauauauauauauauauauauauauauauaguuuua

SEQ ID NO: 756606 - RNA, 64 nt, hsa
uauauauauauauauauauauauauauauauauauauauauauauauauauauauaguuuuacu

SEQ ID NO: 756607 - RNA, 64 nt, hsa
uauauauauauauauauauauauauauauauauauauauauauauauauauauaguuuuacuag

SEQ ID NO: 756608 - RNA, 64 nt, hsa
uauauauauauauauauauauauauauauauauauauauauauauauauauaguuuuacuaggu

SEQ ID NO: 756609 - RNA, 64 nt, hsa
uauauauauauauauauauauauauauauauauauauauauauauauauaguuuuacuagguuu

SEQ ID NO: 756610 - RNA, 64 nt, hsa
uauauauauauauauauauauauauauauauauauauauauauauauaguuuuacuagguuuuc

SEQ ID NO: 756611 - RNA, 64 nt, hsa
uauauauauauauauauauauauauauauauauauauauauauauaguuuuacuagguuuucau

SEQ ID NO: 756612 - RNA, 64 nt, hsa
uauauauauauauauauauauauauauauauauauauauauauaguuuuacuagguuuucaugg

SEQ ID NO: 756613 - RNA, 64 nt, hsa
uauauauauauauauauauauauauauauauauauauauauaguuuuacuagguuuucauggau

SEQ ID NO: 756614 - RNA, 64 nt, hsa
gugaacuaaauauauauguguauauguauacacauauauauacacacacacauauauauauuua

SEQ ID NO: 756615 - RNA, 64 nt, hsa
uguauauguauacacauauauauacacacacacauauauauauuuagaaacgugaguguuaaag

SEQ ID NO: 756616 - RNA, 64 nt, hsa
aguauaaaaaacuuuaauacaaguacauacauauuauauauacacauacauauauauacuauau

SEQ ID NO: 756617 - RNA, 64 nt, hsa
auacaaguacauacauauuauauauacacauacauauauauacuauauauggaugaaacauauu

SEQ ID NO: 756618 - RNA, 64 nt, hsa
gaaaaugaaauguacuucuguuuauucuuaauacuauauauauauauacacacauaguuuuagc

SEQ ID NO: 756619 - RNA, 64 nt, hsa
aaaugaaauguacuucuguuuauucuuaauacuauauauauauauacacacauaguuuuagcaa

SEQ ID NO: 756620 - RNA, 64 nt, hsa
augaaauguacuucuguuuauucuuaauacuauauauauauauacacacauaguuuuagcaaau

SEQ ID NO: 756621 - RNA, 64 nt, hsa
gaaauguacuucuguuuauucuuaauacuauauauauauauacacacauaguuuuagcaaauug

SEQ ID NO: 756622 - RNA, 64 nt, hsa
aauguuaaauuuaauaugcagcauaccauagguguauauauagguauauaauuuuaagguuaaa

SEQ ID NO: 756623 - RNA, 64 nt, hsa
cuuuucaugaaagaguauuuggcugaauguuugcuauauauauguuacuugaaauguuaaauuu

SEQ ID NO: 756624 - RNA, 64 nt, hsa
ugugauuagcuaaccaggaugaaaaauaacagauuauauauaguuugaacuauuuuucgugugc

SEQ ID NO: 756625 - RNA, 64 nt, hsa
ugguuuucuucuacaaaggaaaaaauuggauuuauauauauaagguuacugcauaaugauuuca

SEQ ID NO: 756626 - RNA, 64 nt, hsa
uuugguuuucuucuacaaaggaaaaaauuggauuuauauauauaagguuacugcauaaugauuu

SEQ ID NO: 756627 - RNA, 64 nt, hsa
cauagaaaagguacaguaaaaauauauauauagauauauauaagauauaaaaugguacaccuau

SEQ ID NO: 756628 - RNA, 64 nt, hsa
cauaucuaaacauagaaaagguacaguaaaaauauauauauagauauauauaagauauaaaaug

SEQ ID NO: 756629 - RNA, 64 nt, hsa
aacauaucuaaacauagaaaagguacaguaaaaauauauauauagauauauauaagauauaaaa

SEQ ID NO: 756630 - RNA, 64 nt, hsa
acugguuuuuguuguugcuauguacauauaaauauauauauaaaaugaacauaguucaugcuuu

SEQ ID NO: 756631 - RNA, 64 nt, hsa
agacugguuuuuguuguugcuauguacauauaaauauauauauaaaaugaacauaguucaugcu

SEQ ID NO: 756632 - RNA, 64 nt, hsa
aagaugguccaaaaauagucaaaaauuaaauauauauauauauuaguaauuuauauagauguca

SEQ ID NO: 756633 - RNA, 64 nt, hsa
uaaagaugguccaaaaauagucaaaaauuaaauauauauauauauuaguaauuuauauagaugu

SEQ ID NO: 756634 - RNA, 64 nt, hsa
aauaaagaugguccaaaaauagucaaaaauuaaauauauauauauauuaguaauuuauauagau

SEQ ID NO: 756635 - RNA, 64 nt, hsa
uuugauccuaucgacaaucauaauaauaauaaauuauauauauaacccauauaauaacgauggu

SEQ ID NO: 756636 - RNA, 64 nt, hsa
ugauccuaucgacaaucauaauaauaauaaauuauauauauaacccauauaauaacgaugguga

SEQ ID NO: 756637 - RNA, 64 nt, hsa
uauuuacagcuaaccuaucuauucauauuuuacauauauauauauauauauacaugcacacaca

SEQ ID NO: 756638 - RNA, 64 nt, hsa
uuuacagcuaaccuaucuauucauauuuuacauauauauauauauauauacaugcacacacacc

SEQ ID NO: 756639 - RNA, 64 nt, hsa
uacagcuaaccuaucuauucauauuuuacauauauauauauauauauacaugcacacacaccga

SEQ ID NO: 756640 - RNA, 64 nt, hsa
cagcuaaccuaucuauucauauuuuacauauauauauauauauauacaugcacacacaccgaua

SEQ ID NO: 756641 - RNA, 64 nt, hsa
gcuaaccuaucuauucauauuuuacauauauauauauauauauacaugcacacacaccgauaca

SEQ ID NO: 756642 - RNA, 64 nt, hsa
uaaccuaucuauucauauuuuacauauauauauauauauauacaugcacacacaccgauacauu

SEQ ID NO: 756643 - RNA, 64 nt, hsa
cuuuccaggagacauauauaggggaacaucacccuauauauaauuugaguguauauauauuuau

SEQ ID NO: 756644 - RNA, 64 nt, hsa
auaggggaacaucacccuauauauaauuugaguguauauauauuuauauauaugauguggacau

SEQ ID NO: 756645 - RNA, 64 nt, hsa
aucacccuauauauaauuugaguguauauauauuuauauauaugauguggacauauguauacuu

SEQ ID NO: 756646 - RNA, 64 nt, hsa
cuccauuaccccuaaguuauuaguuugucuaguuuauauauaaagaccauguuuuaaaguacau

SEQ ID NO: 756647 - RNA, 64 nt, hsa
uaaaauguuaaagaaaaacauuucuauauugaaauauauauaauuuauaaugaaaauuauagua

SEQ ID NO: 756648 - RNA, 64 nt, hsa
gagauuuuagucuggcuauaaaugcuuuguuugauauauauaugugcacauauauauauuacuu

SEQ ID NO: 756649 - RNA, 64 nt, hsa
uauaaaugcuuuguuugauauauauaugugcacauauauauauuacuuaaccauaugaauuuua

SEQ ID NO: 756650 - RNA, 64 nt, hsa
gugacacacacacaaaaggaauuuaauaguauaauauauauauaaauaaauauauauacagaua

SEQ ID NO: 756651 - RNA, 64 nt, hsa
gacacacacacaaaaggaauuuaauaguauaauauauauauaaauaaauauauauacagauaua

SEQ ID NO: 756652 - RNA, 64 nt, hsa
aggaauuuaauaguauaauauauauauaaauaaauauauauacagauauauuuaucaugguaug

SEQ ID NO: 756653 - RNA, 64 nt, hsa
cacacacaucuacuauuuuagauaaauguacuguuauauauauauguaaacuacuauugcucuc

SEQ ID NO: 756654 - RNA, 64 nt, hsa
cacacaucuacuauuuuagauaaauguacuguuauauauauauguaaacuacuauugcucucuu

SEQ ID NO: 756655 - RNA, 64 nt, hsa
uuuuuacucuaaaauucaauguaauuaaauuucauauauauauaauauauacauauauacauag

SEQ ID NO: 756656 - RNA, 64 nt, hsa
uuuacucuaaaauucaauguaauuaaauuucauauauauauaauauauacauauauacauagug

SEQ ID NO: 756657 - RNA, 64 nt, hsa
agaaauauuuuccuuuguuauguacggauauauauauauauagucuuccaagauagaaguuuac

SEQ ID NO: 756658 - RNA, 64 nt, hsa
ccagaaauauuuuccuuuguuauguacggauauauauauauauagucuuccaagauagaaguuu

SEQ ID NO: 756659 - RNA, 64 nt, hsa
agccagaaauauuuuccuuuguuauguacggauauauauauauauagucuuccaagauagaagu

SEQ ID NO: 756660 - RNA, 64 nt, hsa
agagccagaaauauuuuccuuuguuauguacggauauauauauauauagucuuccaagauagaa

SEQ ID NO: 756661 - RNA, 64 nt, hsa
gacuugguaagucuacuguauauaacaucuaauauauauauauuauaggccagcuacaaggggu

SEQ ID NO: 756662 - RNA, 64 nt, hsa
uugacuugguaagucuacuguauauaacaucuaauauauauauauuauaggccagcuacaaggg

SEQ ID NO: 756663 - RNA, 64 nt, hsa
uugacuugguaagucuacuguauauaacaucuaauauauauauuacaggccaaaugaacuaaac

SEQ ID NO: 756664 - RNA, 64 nt, hsa
ugaauauagacucgagucuuugggaaacucauuauauauauauuuuuuaaagaguuugaagcaa

SEQ ID NO: 756665 - RNA, 64 nt, hsa
uuugaauauagacucgagucuuugggaaacucauuauauauauauuuuuuaaagaguuugaagc

SEQ ID NO: 756666 - RNA, 64 nt, hsa
auggggagguuuuuaguuauauaugcuauauauauauauauaacuggaaauguuuuauauguuu

SEQ ID NO: 756667 - RNA, 64 nt, hsa
agauggggagguuuuuaguuauauaugcuauauauauauauauaacuggaaauguuuuauaugu

SEQ ID NO: 756668 - RNA, 64 nt, hsa
agagauggggagguuuuuaguuauauaugcuauauauauauauauaacuggaaauguuuuauau

SEQ ID NO: 756669 - RNA, 64 nt, hsa
agagagauggggagguuuuuaguuauauaugcuauauauauauauauaacuggaaauguuuuau

SEQ ID NO: 756670 - RNA, 64 nt, hsa
caagagagauggggagguuuuuaguuauauaugcuauauauauauauauaacuggaaauguuuu

SEQ ID NO: 756671 - RNA, 64 nt, hsa
aaugguacauauuuuuaaaguuaaguagcaugcauauauauaugcacacacaccucuuuuucag

SEQ ID NO: 756672 - RNA, 64 nt, hsa
guauauacauauguguguauauacaguauauacauauauauauuuucacuugcuuucaagauga

SEQ ID NO: 756673 - RNA, 64 nt, hsa
accugaaucugacaaagaugaaauccacuuuuaauauauauacauauauauuuguuaauauauu

SEQ ID NO: 756674 - RNA, 63 nt, hsa
ggcuguauuuuauauauauauauauauauauauauauauauauaucuuauuggcucucugcuu

SEQ ID NO: 756675 - RNA, 64 nt, hsa
agggcuguauuuuauauauauauauauauauauauauauauauauaucuuauuggcucucugcu

SEQ ID NO: 756676 - RNA, 64 nt, hsa
cuagggcuguauuuuauauauauauauauauauauauauauauauauaucuuauuggcucucug

SEQ ID NO: 756677 - RNA, 64 nt, hsa
aucuagggcuguauuuuauauauauauauauauauauauauauauauauaucuuauuggcucuc

SEQ ID NO: 756678 - RNA, 64 nt, hsa
aaaucuagggcuguauuuuauauauauauauauauauauauauauauauauaucuuauuggcuc

SEQ ID NO: 756679 - RNA, 64 nt, hsa
caaaaucuagggcuguauuuuauauauauauauauauauauauauauauauauaucuuauuggc

SEQ ID NO: 756680 - RNA, 64 nt, hsa
aacaaaaucuagggcuguauuuuauauauauauauauauauauauauauauauauaucuuauug

SEQ ID NO: 756681 - RNA, 64 nt, hsa
aaaacaaaaucuagggcuguauuuuauauauauauauauauauauauauauauauauaucuuau

SEQ ID NO: 756682 - RNA, 64 nt, hsa
aaaaaacaaaaucuagggcuguauuuuauauauauauauauauauauauauauauauauaucuu

SEQ ID NO: 756683 - RNA, 64 nt, hsa
aaaaaaaacaaaaucuagggcuguauuuuauauauauauauauauauauauauauauauauauc

SEQ ID NO: 756684 - RNA, 64 nt, hsa
acaaaaaaaacaaaaucuagggcuguauuuuauauauauauauauauauauauauauauauaua

SEQ ID NO: 756685 - RNA, 64 nt, hsa
aaacaaaaaaaacaaaaucuagggcuguauuuuauauauauauauauauauauauauauauaua

SEQ ID NO: 756686 - RNA, 64 nt, hsa
aaaaacaaaaaaaacaaaaucuagggcuguauuuuauauauauauauauauauauauauauaua

SEQ ID NO: 756687 - RNA, 64 nt, hsa
guacauaauaugcaauuauauaucugauauauauuauauauaaaauaauauaccuaaguguuuu

SEQ ID NO: 756688 - RNA, 64 nt, hsa
agaguuuuguauuauggauucaacuuauauauaauauauauaagguacauaauaugcaauuaua

SEQ ID NO: 756689 - RNA, 64 nt, hsa
aauguuuggagaguuuuguauuauggauucaacuuauauauaauauauauaagguacauaauau

SEQ ID NO: 756690 - RNA, 64 nt, hsa
cuuuugaacguuggccuuacaaucaaauguaaguuauauauauuuguacugaugaaaauuuaua

SEQ ID NO: 756691 - RNA, 64 nt, hsa
guugagcuuccauuuugaguaacagaauaaauauuauauauaucaaaagccaaaaucuuuauuu

SEQ ID NO: 756692 - RNA, 64 nt, hsa
cccuaaaugguauggccaaaagucagaguuaaaauauauauaguuagauuccaacuuccuccuu

SEQ ID NO: 756693 - RNA, 64 nt, hsa
auaguauaugauuauaaugcuauuuuaaaaaauauauauauaaaauauuuuuuucuuuuuaaaa

SEQ ID NO: 756694 - RNA, 64 nt, hsa
cuauaguauaugauuauaaugcuauuuuaaaaaauauauauauaaaauauuuuuuucuuuuuaa

SEQ ID NO: 756695 - RNA, 64 nt, hsa
cauacacacauacauacauacauacaaauauauguauauauauucucagcugcugcgggaggua

SEQ ID NO: 756696 - RNA, 64 nt, hsa
cagcugauauuuguuuugaaagugaaucucauaauauauauauguauuacacauuauuaugacu

SEQ ID NO: 756697 - RNA, 64 nt, hsa
gaugccuccaggaaacuuaaguauuuuauuaauauauauauaggaauuuuuuuuuauuuugcuu

SEQ ID NO: 756698 - RNA, 64 nt, hsa
uugaugccuccaggaaacuuaaguauuuuauuaauauauauauaggaauuuuuuuuuauuuugc

SEQ ID NO: 756699 - RNA, 64 nt, hsa
aagguugcucucagaaaaaaaaaaaaagcauauauauauauaaaauaaaauuuaggccauggga

SEQ ID NO: 756700 - RNA, 64 nt, hsa
guaagguugcucucagaaaaaaaaaaaaagcauauauauauauaaaauaaaauuuaggccaugg

SEQ ID NO: 756701 - RNA, 64 nt, hsa
gaguaagguugcucucagaaaaaaaaaaaaagcauauauauauauaaaauaaaauuuaggccau

SEQ ID NO: 756702 - RNA, 64 nt, hsa
caggauauuugggauccucuuuucuauguauguauauauauaaaaaacuaugaaucacucacac

SEQ ID NO: 756703 - RNA, 64 nt, hsa
ugcaggauauuugggauccucuuuucuauguauguauauauauaaaaaacuaugaaucacucac

SEQ ID NO: 756704 - RNA, 64 nt, hsa
ccuaauuauauaaaaauauauauauaaacacacauauauauagugauuucuaaagauuuguuua

SEQ ID NO: 756705 - RNA, 64 nt, hsa
uugaaaugaugauaauccuaauuauauaaaaauauauauauaaacacacauauauauagugauu

SEQ ID NO: 756706 - RNA, 64 nt, hsa
guuugaaaugaugauaauccuaauuauauaaaaauauauauauaaacacacauauauauaguga

SEQ ID NO: 756707 - RNA, 64 nt, hsa
aauaauuuauauuuggaaauauauauuuaagaauuauauauauaaaaauauauauguauaagag

SEQ ID NO: 756708 - RNA, 64 nt, hsa
uaauuuauauuuggaaauauauauuuaagaauuauauauauaaaaauauauauguauaagaguu

SEQ ID NO: 756709 - RNA, 64 nt, hsa
aaacuuuucuuccccuuccuaguucugaaguagauauauauauauauauaucuacugucacauu

SEQ ID NO: 756710 - RNA, 64 nt, hsa
acuuuucuuccccuuccuaguucugaaguagauauauauauauauauaucuacugucacauucc

SEQ ID NO: 756711 - RNA, 64 nt, hsa
uuuucuuccccuuccuaguucugaaguagauauauauauauauauaucuacugucacauuccau

SEQ ID NO: 756712 - RNA, 64 nt, hsa
uucuuccccuuccuaguucugaaguagauauauauauauauauaucuacugucacauuccauau

SEQ ID NO: 756713 - RNA, 64 nt, hsa
cuuccccuuccuaguucugaaguagauauauauauauauauaucuacugucacauuccauauau

SEQ ID NO: 756714 - RNA, 64 nt, hsa
uaucuaaaaggccagcuaccugccuaggagccacuauauauauagauagauguagguuaugaac

SEQ ID NO: 756715 - RNA, 64 nt, hsa
ucuaaaaggccagcuaccugccuaggagccacuauauauauagauagauguagguuaugaaccc

SEQ ID NO: 756716 - RNA, 64 nt, hsa
uugucaguacuuuacuuuuuuccccccaaauagguauauauagacugcagaagcuucaguccca

SEQ ID NO: 756717 - RNA, 64 nt, hsa
gaaauuguuaggugaaaguguuuuugagaauuuuuauauauauuacucacugcagagaucaugu

SEQ ID NO: 756718 - RNA, 64 nt, hsa
uucuuucucuuccuccuuccucuuccuuacuuuuuauauauauauauaaagaaaaugauacagc

SEQ ID NO: 756719 - RNA, 64 nt, hsa
cuuucucuuccuccuuccucuuccuuacuuuuuauauauauauauaaagaaaaugauacagcag

SEQ ID NO: 756720 - RNA, 64 nt, hsa
uucucuuccuccuuccucuuccuuacuuuuuauauauauauauaaagaaaaugauacagcagag

SEQ ID NO: 756721 - RNA, 64 nt, hsa
cucuuccuccuuccucuuccuuacuuuuuauauauauauauaaagaaaaugauacagcagagcu

SEQ ID NO: 756722 - RNA, 64 nt, hsa
caaaaaaaaaaacaaacaaacaaaaaaaaaaccauauauauacauauauauauagcagcuuuau

SEQ ID NO: 756723 - RNA, 64 nt, hsa
aacaaacaaacaaaaaaaaaaccauauauauacauauauauauagcagcuuuauggagauauaa

SEQ ID NO: 756724 - RNA, 64 nt, hsa
caaacaaacaaaaaaaaaaccauauauauacauauauauauagcagcuuuauggagauauaauu

SEQ ID NO: 756725 - RNA, 64 nt, hsa
uucuccuucccuacuuuguacaaaggaccagaguuauauauauauauauauguauaugucugua

SEQ ID NO: 756726 - RNA, 64 nt, hsa
cuccuucccuacuuuguacaaaggaccagaguuauauauauauauauauguauaugucuguacc

SEQ ID NO: 756727 - RNA, 64 nt, hsa
ccuucccuacuuuguacaaaggaccagaguuauauauauauauauauguauaugucuguacccc

SEQ ID NO: 756728 - RNA, 64 nt, hsa
uucccuacuuuguacaaaggaccagaguuauauauauauauauauguauaugucuguaccccag

SEQ ID NO: 756729 - RNA, 64 nt, hsa
cccuacuuuguacaaaggaccagaguuauauauauauauauauguauaugucuguaccccagcc

SEQ ID NO: 756730 - RNA, 64 nt, hsa
uuuuuaaaacugaaaauauuuuucucuugcuauuuauauauauaugauaaaaaugcuuggaaga

SEQ ID NO: 756731 - RNA, 64 nt, hsa
uuuaaaacugaaaauauuuuucucuugcuauuuauauauauaugauaaaaaugcuuggaagagu

SEQ ID NO: 756732 - RNA, 64 nt, hsa
uuuucuuuguuaaaguguaaaacagugaccagaauauauauaucuauaccugcauauauauauu

SEQ ID NO: 756733 - RNA, 64 nt, hsa
aacagugaccagaauauauauaucuauaccugcauauauauauugaccugaguauuuauaacug

SEQ ID NO: 756734 - RNA, 64 nt, hsa
ggacaugaguuaaauauauuuauauguacauacauauauauaucccuuuacauauauauguaug

SEQ ID NO: 756735 - RNA, 64 nt, hsa
uauaugaaagaaaacacccuuaugaauugaugacuauauauaaaauuauauucacuacuuuuga

SEQ ID NO: 756736 - RNA, 64 nt, hsa
uuugguugguuuucauuguaggggagggauuuuuuauauauauauaaaaacacacaccacaugc

SEQ ID NO: 756737 - RNA, 64 nt, hsa
ugguugguuuucauuguaggggagggauuuuuuauauauauauaaaaacacacaccacaugcuu

SEQ ID NO: 756738 - RNA, 64 nt, hsa
guugguuuucauuguaggggagggauuuuuuauauauauauaaaaacacacaccacaugcuuga

SEQ ID NO: 756739 - RNA, 64 nt, hsa
aaacugucuacagagaaguaaauaucuauaucuauauauauaaauauacuuucagcauaacaga

SEQ ID NO: 756740 - RNA, 64 nt, hsa
aaaaacugucuacagagaaguaaauaucuauaucuauauauauaaauauacuuucagcauaaca

SEQ ID NO: 756741 - RNA, 64 nt, hsa
acgcaauuguauauauaugugaacuuucucagcauauauauaaaauacacguguauaugaggau

SEQ ID NO: 756742 - RNA, 64 nt, hsa
caagcagacacacacauauauacauacgcaauuguauauauaugugaacuuucucagcauauau

SEQ ID NO: 756743 - RNA, 64 nt, hsa
gcuguggucauuuguaauguaaagaucaguuauauauauauauuuguaaugagagcaaguauau

SEQ ID NO: 756744 - RNA, 64 nt, hsa
cugcuguggucauuuguaauguaaagaucaguuauauauauauauuuguaaugagagcaaguau

SEQ ID NO: 756745 - RNA, 64 nt, hsa
cacugcuguggucauuuguaauguaaagaucaguuauauauauauauuuguaaugagagcaagu

SEQ ID NO: 756746 - RNA, 64 nt, hsa
uauuugacuuuuuaaaaucuucugacacaguaaauauauauaucaagauugauguaucaaaauu

SEQ ID NO: 756747 - RNA, 64 nt, hsa
uuguaaauauauguuacgaaucuucuuaaauauauauauauacacacccugugagaacuguaaa

SEQ ID NO: 756748 - RNA, 64 nt, hsa
aauuguaaauauauguuacgaaucuucuuaaauauauauauauacacacccugugagaacugua

SEQ ID NO: 756749 - RNA, 64 nt, hsa
auaauuguaaauauauguuacgaaucuucuuaaauauauauauauacacacccugugagaacug

SEQ ID NO: 756750 - RNA, 64 nt, hsa
uacagcugcagaucucucuguguauaucuaucuauauauauauuuuuuauuacuugggagaaug

SEQ ID NO: 756751 - RNA, 64 nt, hsa
aguacagcugcagaucucucuguguauaucuaucuauauauauauuuuuuauuacuugggagaa

SEQ ID NO: 756752 - RNA, 64 nt, hsa
cucaucaacaucagcuaaauauagcugauauauauauauauauuuaucugaaacgugauauuuu

SEQ ID NO: 756753 - RNA, 64 nt, hsa
uacucaucaacaucagcuaaauauagcugauauauauauauauauuuaucugaaacgugauauu

SEQ ID NO: 756754 - RNA, 64 nt, hsa
gcuacucaucaacaucagcuaaauauagcugauauauauauauauauuuaucugaaacgugaua

SEQ ID NO: 756755 - RNA, 64 nt, hsa
cagcuacucaucaacaucagcuaaauauagcugauauauauauauauauuuaucugaaacguga

SEQ ID NO: 756756 - RNA, 64 nt, hsa
accuacagauauauacaguauauaaauauauauauauauauauuuauauuuuugggggugggag

SEQ ID NO: 756757 - RNA, 64 nt, hsa
aaaccuacagauauauacaguauauaaauauauauauauauauauuuauauuuuuggggguggg

SEQ ID NO: 756758 - RNA, 64 nt, hsa
caaaaccuacagauauauacaguauauaaauauauauauauauauauuuauauuuuugggggug

SEQ ID NO: 756759 - RNA, 64 nt, hsa
agcaaaaccuacagauauauacaguauauaaauauauauauauauauauuuauauuuuuggggg

SEQ ID NO: 756760 - RNA, 64 nt, hsa
acagcaaaaccuacagauauauacaguauauaaauauauauauauauauauuuauauuuuuggg

SEQ ID NO: 756761 - RNA, 63 nt, hsa
cauccccuggaguuuuuaaaaauaaauaaauauauauauauauaaaaaaaacucuuuuauguc

SEQ ID NO: 756762 - RNA, 64 nt, hsa
gacauccccuggaguuuuuaaaaauaaauaaauauauauauauauaaaaaaaacucuuuuaugu

SEQ ID NO: 756763 - RNA, 64 nt, hsa
gggacauccccuggaguuuuuaaaaauaaauaaauauauauauauauaaaaaaaacucuuuuau

SEQ ID NO: 756764 - RNA, 64 nt, hsa
ucuuucaauaguuugggaauugaaagauucuuguuauauauagcuaguuuggguuuguuuuugu

SEQ ID NO: 756765 - RNA, 64 nt, hsa
uacuuucaagagaaaacuguguauacacaugaaauauauauauauauauauauauauauaugua

SEQ ID NO: 756766 - RNA, 64 nt, hsa
cuuucaagagaaaacuguguauacacaugaaauauauauauauauauauauauauauauguaua

SEQ ID NO: 756767 - RNA, 64 nt, hsa
uucaagagaaaacuguguauacacaugaaauauauauauauauauauauauauauauguauaau

SEQ ID NO: 756768 - RNA, 64 nt, hsa
caagagaaaacuguguauacacaugaaauauauauauauauauauauauauauauguauaauau

SEQ ID NO: 756769 - RNA, 64 nt, hsa
agagaaaacuguguauacacaugaaauauauauauauauauauauauauauauguauaauauau

SEQ ID NO: 756770 - RNA, 64 nt, hsa
agaaaacuguguauacacaugaaauauauauauauauauauauauauauauguauaauauauaa

SEQ ID NO: 756771 - RNA, 64 nt, hsa
aaaacuguguauacacaugaaauauauauauauauauauauauauauauguauaauauauaaag

SEQ ID NO: 756772 - RNA, 64 nt, hsa
aacuguguauacacaugaaauauauauauauauauauauauauauauguauaauauauaaagac

SEQ ID NO: 756773 - RNA, 64 nt, hsa
cuguguauacacaugaaauauauauauauauauauauauauauauguauaauauauaaagacug

SEQ ID NO: 756774 - RNA, 64 nt, hsa
guguauacacaugaaauauauauauauauauauauauauauauguauaauauauaaagacuggc

SEQ ID NO: 756775 - RNA, 64 nt, hsa
cuuuauccucuaaaauauguuaagggauaaauucuauauauauaguuaugcauuugcugucaua

SEQ ID NO: 756776 - RNA, 64 nt, hsa
uuauccucuaaaauauguuaagggauaaauucuauauauauaguuaugcauuugcugucauacc

SEQ ID NO: 756777 - RNA, 64 nt, hsa
uuucuuuuauauacauguuuuucuuuuacaugcauauauauauauuuuauuuuauuuuauguuu

SEQ ID NO: 756778 - RNA, 64 nt, hsa
ucuuuuauauacauguuuuucuuuuacaugcauauauauauauuuuauuuuauuuuauguuuuu

SEQ ID NO: 756779 - RNA, 64 nt, hsa
ggcaaagaugaaaguauagccaacuauucuuggcuauauauauauauucaagugggccgggcgu

SEQ ID NO: 756780 - RNA, 64 nt, hsa
caaagaugaaaguauagccaacuauucuuggcuauauauauauauucaagugggccgggcguga

SEQ ID NO: 756781 - RNA, 64 nt, hsa
aagaugaaaguauagccaacuauucuuggcuauauauauauauucaagugggccgggcgugaug

SEQ ID NO: 756782 - RNA, 64 nt, hsa
uucuuaacccagucuuaggcugguauucccuuuuuauauauaucuauauuacuuuucaccucuu

SEQ ID NO: 756783 - RNA, 64 nt, hsa
acugagugaguacauuggcauaaauauagaaauuuauauauauacauauauauaaacuauucuu

SEQ ID NO: 756784 - RNA, 64 nt, hsa
ugagugaguacauuggcauaaauauagaaauuuauauauauacauauauauaaacuauucuuuu

SEQ ID NO: 756785 - RNA, 64 nt, hsa
cauuggcauaaauauagaaauuuauauauauacauauauauaaacuauucuuuuuugccacaca

SEQ ID NO: 756786 - RNA, 64 nt, hsa
guguaaaaacaaauuuccauauguuuuauauaaauauauauauaauaugaaggacuacccuccu

SEQ ID NO: 756787 - RNA, 64 nt, hsa
guaaaaacaaauuuccauauguuuuauauaaauauauauauaauaugaaggacuacccuccuuu

SEQ ID NO: 756788 - RNA, 64 nt, hsa
uauauauauauauauauauauauauauauauauauauauauaugguaaacaagcacacacaauu

SEQ ID NO: 756789 - RNA, 64 nt, hsa
uauauauauauauauauauauauauauauauauauauauauauaugguaaacaagcacacacaa

SEQ ID NO: 756790 - RNA, 64 nt, hsa
cauauauauauauauauauauauauauauauauauauauauauauaugguaaacaagcacacac

SEQ ID NO: 756791 - RNA, 64 nt, hsa
uccauauauauauauauauauauauauauauauauauauauauauauaugguaaacaagcacac

SEQ ID NO: 756792 - RNA, 64 nt, hsa
uauccauauauauauauauauauauauauauauauauauauauauauauaugguaaacaagcac

SEQ ID NO: 756793 - RNA, 64 nt, hsa
uauauccauauauauauauauauauauauauauauauauauauauauauauaugguaaacaagc

SEQ ID NO: 756794 - RNA, 64 nt, hsa
uauauauccauauauauauauauauauauauauauauauauauauauauauauaugguaaacaa

SEQ ID NO: 756795 - RNA, 64 nt, hsa
auuauauauccauauauauauauauauauauauauauauauauauauauauauauaugguaaac

SEQ ID NO: 756796 - RNA, 64 nt, hsa
gaauuauauauccauauauauauauauauauauauauauauauauauauauauauauaugguaa

SEQ ID NO: 756797 - RNA, 64 nt, hsa
ucgaauuauauauccauauauauauauauauauauauauauauauauauauauauauauauggu

SEQ ID NO: 756798 - RNA, 64 nt, hsa
gaucgaauuauauauccauauauauauauauauauauauauauauauauauauauauauauaug

SEQ ID NO: 756799 - RNA, 64 nt, hsa
cagaucgaauuauauauccauauauauauauauauauauauauauauauauauauauauauaua

SEQ ID NO: 756800 - RNA, 64 nt, hsa
cucagaucgaauuauauauccauauauauauauauauauauauauauauauauauauauauaua

SEQ ID NO: 756801 - RNA, 64 nt, hsa
agcucagaucgaauuauauauccauauauauauauauauauauauauauauauauauauauaua

SEQ ID NO: 756802 - RNA, 64 nt, hsa
ccagcucagaucgaauuauauauccauauauauauauauauauauauauauauauauauauaua

SEQ ID NO: 756803 - RNA, 64 nt, hsa
ucccagcucagaucgaauuauauauccauauauauauauauauauauauauauauauauauaua

SEQ ID NO: 756804 - RNA, 64 nt, hsa
agucccagcucagaucgaauuauauauccauauauauauauauauauauauauauauauauaua

SEQ ID NO: 756805 - RNA, 64 nt, hsa
ucagucccagcucagaucgaauuauauauccauauauauauauauauauauauauauauauaua

SEQ ID NO: 756806 - RNA, 64 nt, hsa
ucucagucccagcucagaucgaauuauauauccauauauauauauauauauauauauauauaua

SEQ ID NO: 756807 - RNA, 64 nt, hsa
aaaacaaaugagauuauauauauauauauaaaaauauauauauuaaaaaaaaagacaguauuua

SEQ ID NO: 756808 - RNA, 64 nt, hsa
uuucauaaguaaaaaacaaaugagauuauauauauauauauaaaaauauauauauuaaaaaaaa

SEQ ID NO: 756809 - RNA, 64 nt, hsa
auuuucauaaguaaaaaacaaaugagauuauauauauauauauaaaaauauauauauuaaaaaa

SEQ ID NO: 756810 - RNA, 64 nt, hsa
uuauuuucauaaguaaaaaacaaaugagauuauauauauauauauaaaaauauauauauuaaaa

SEQ ID NO: 756811 - RNA, 64 nt, hsa
uauuauuuucauaaguaaaaaacaaaugagauuauauauauauauauaaaaauauauauauuaa

SEQ ID NO: 756812 - RNA, 64 nt, hsa
cuuauuauuuucauaaguaaaaaacaaaugagauuauauauauauauauaaaaauauauauauu

SEQ ID NO: 756813 - RNA, 64 nt, hsa
gggcccuuuuucccuucccuccuuuguuuacuuauauauauauuuuuuuuaaacuuaaauuuug

SEQ ID NO: 756814 - RNA, 64 nt, hsa
uugggcccuuuuucccuucccuccuuuguuuacuuauauauauauuuuuuuuaaacuuaaauuu

SEQ ID NO: 756815 - RNA, 64 nt, hsa
aauaggaucacugccugccagaucuucaaacuuuuauauauauauauauauauauauauauaua

SEQ ID NO: 756816 - RNA, 64 nt, hsa
uaggaucacugccugccagaucuucaaacuuuuauauauauauauauauauauauauauauaua

SEQ ID NO: 756817 - RNA, 64 nt, hsa
ggaucacugccugccagaucuucaaacuuuuauauauauauauauauauauauauauauauaua

SEQ ID NO: 756818 - RNA, 64 nt, hsa
aucacugccugccagaucuucaaacuuuuauauauauauauauauauauaaaugccacgguccu

SEQ ID NO: 756819 - RNA, 64 nt, hsa
cacugccugccagaucuucaaacuuuuauauauauauauauauauauaaaugccacgguccugc

SEQ ID NO: 756820 - RNA, 64 nt, hsa
cugccugccagaucuucaaacuuuuauauauauauauauauauauaaaugccacgguccugcuc

SEQ ID NO: 756821 - RNA, 64 nt, hsa
gccugccagaucuucaaacuuuuauauauauauauauauauauaaaugccacgguccugcucug

SEQ ID NO: 756822 - RNA, 64 nt, hsa
cugccagaucuucaaacuuuuauauauauauauauauauauaaaugccacgguccugcucuggu

SEQ ID NO: 756823 - RNA, 64 nt, hsa
aaaagaggauuaaguaaaauaaaaugagagcaauuauauauauaaauauauaucauacacagag

SEQ ID NO: 756824 - RNA, 64 nt, hsa
aagaggauuaaguaaaauaaaaugagagcaauuauauauauaaauauauaucauacacagagcc

SEQ ID NO: 756825 - RNA, 64 nt, hsa
gcuagauuucguguacaaaaccuguguaccccucuauauauauguuacauagaauguauauaug

SEQ ID NO: 756826 - RNA, 64 nt, hsa
acguguguauuauaucuggccucguuauauaguguauauauauguauacauauacauauauaua

SEQ ID NO: 756827 - RNA, 64 nt, hsa
cguuauauaguguauauauauguauacauauacauauauauaauauauaugaagacuguaaaug

SEQ ID NO: 756828 - RNA, 64 nt, hsa
agacuaaacuuuuguuuuccuuacccaguauaaauauauauauauauauuuaaucuauuuuuau

SEQ ID NO: 756829 - RNA, 64 nt, hsa
acuaaacuuuuguuuuccuuacccaguauaaauauauauauauauauuuaaucuauuuuuauua

SEQ ID NO: 756830 - RNA, 64 nt, hsa
uaaacuuuuguuuuccuuacccaguauaaauauauauauauauauuuaaucuauuuuuauuaga

SEQ ID NO: 756831 - RNA, 64 nt, hsa
aacuuuuguuuuccuuacccaguauaaauauauauauauauauuuaaucuauuuuuauuagaag

SEQ ID NO: 756832 - RNA, 64 nt, hsa
ucaucuaaacugaguccagcugccuaauucugaauauauauauauauauaucuuuucaccauau

SEQ ID NO: 756833 - RNA, 64 nt, hsa
aucuaaacugaguccagcugccuaauucugaauauauauauauauauaucuuuucaccauauac

SEQ ID NO: 756834 - RNA, 64 nt, hsa
cuaaacugaguccagcugccuaauucugaauauauauauauauauaucuuuucaccauauacau

SEQ ID NO: 756835 - RNA, 64 nt, hsa
aaacugaguccagcugccuaauucugaauauauauauauauauaucuuuucaccauauacaugc

SEQ ID NO: 756836 - RNA, 64 nt, hsa
acugaguccagcugccuaauucugaauauauauauauauauaucuuuucaccauauacaugccu

SEQ ID NO: 756837 - RNA, 64 nt, hsa
accucauuaucaguccaaagggcauggguuuuauuauauauauauauuuuuuuuuuuaaaaaaa

SEQ ID NO: 756838 - RNA, 64 nt, hsa
cucauuaucaguccaaagggcauggguuuuauuauauauauauauuuuuuuuuuuaaaaaaaaa

SEQ ID NO: 756839 - RNA, 64 nt, hsa
cauuaucaguccaaagggcauggguuuuauuauauauauauauuuuuuuuuuuaaaaaaaaaac

SEQ ID NO: 756840 - RNA, 64 nt, hsa
augcugcuucauuuacccaggaggucauauucuuuauauauauuuuuuguugcaaagugucucu

SEQ ID NO: 756841 - RNA, 64 nt, hsa
ucuauauauuauucgaauuuuuaaauuauuuguuuauauauaaaagaaaagcucaauuggcugu

SEQ ID NO: 756842 - RNA, 64 nt, hsa
gcauauaauggaguuaacgggugaauaauaaaaguauauauauauauuauauauauauaaauau

SEQ ID NO: 756843 - RNA, 64 nt, hsa
auauaauggaguuaacgggugaauaauaaaaguauauauauauauuauauauauauaaauauuu

SEQ ID NO: 756844 - RNA, 64 nt, hsa
auaauggaguuaacgggugaauaauaaaaguauauauauauauuauauauauauaaauauuuua

SEQ ID NO: 756845 - RNA, 64 nt, hsa
uuaacgggugaauaauaaaaguauauauauauauuauauauauauaaauauuuuaaauaucuuu

SEQ ID NO: 756846 - RNA, 64 nt, hsa
aacgggugaauaauaaaaguauauauauauauuauauauauauaaauauuuuaaauaucuuuca

SEQ ID NO: 756847 - RNA, 64 nt, hsa
cgggugaauaauaaaaguauauauauauauuauauauauauaaauauuuuaaauaucuuucaug

SEQ ID NO: 756848 - RNA, 64 nt, hsa
uuacuuaagauucaguuuucccacuuuuugguaauauauauauuuuugugaauuauacuuuguu

SEQ ID NO: 756849 - RNA, 64 nt, hsa
uaaauacugacaauguauuuuggaagacauauauuauauauagaaaagaggagaggaaaacuau

SEQ ID NO: 756850 - RNA, 64 nt, hsa
caguagcuauagccauuaaccaaaggacagaugauauauauauauaugauauauauauauauau

SEQ ID NO: 756851 - RNA, 64 nt, hsa
guagcuauagccauuaaccaaaggacagaugauauauauauauaugauauauauauauauauaa

SEQ ID NO: 756852 - RNA, 64 nt, hsa
agcuauagccauuaaccaaaggacagaugauauauauauauaugauauauauauauauauaagu

SEQ ID NO: 756853 - RNA, 64 nt, hsa
uuaaccaaaggacagaugauauauauauauaugauauauauauauauauaaguucuuuuuuagc

SEQ ID NO: 756854 - RNA, 64 nt, hsa
aaccaaaggacagaugauauauauauauaugauauauauauauauauaaguucuuuuuuagcug

SEQ ID NO: 756855 - RNA, 64 nt, hsa
ccaaaggacagaugauauauauauauaugauauauauauauauauaaguucuuuuuuagcugua

SEQ ID NO: 756856 - RNA, 64 nt, hsa
aaaggacagaugauauauauauauaugauauauauauauauauaaguucuuuuuuagcuguacc

SEQ ID NO: 756857 - RNA, 64 nt, hsa
aggacagaugauauauauauauaugauauauauauauauauaaguucuuuuuuagcuguaccua

SEQ ID NO: 756858 - RNA, 64 nt, hsa
uauauauauauauauauauauauauauauauauauauauauacacaaaugcacagucccccucc

SEQ ID NO: 756859 - RNA, 64 nt, hsa
cauauauauauauauauauauauauauauauauauauauauauacacaaaugcacagucccccu

SEQ ID NO: 756860 - RNA, 64 nt, hsa
uacauauauauauauauauauauauauauauauauauauauauauacacaaaugcacagucccc

SEQ ID NO: 756861 - RNA, 64 nt, hsa
ucuacauauauauauauauauauauauauauauauauauauauauauacacaaaugcacagucc

SEQ ID NO: 756862 - RNA, 64 nt, hsa
acucuacauauauauauauauauauauauauauauauauauauauauauacacaaaugcacagu

SEQ ID NO: 756863 - RNA, 64 nt, hsa
acacucuacauauauauauauauauauauauauauauauauauauauauauacacaaaugcaca

SEQ ID NO: 756864 - RNA, 64 nt, hsa
ucacacucuacauauauauauauauauauauauauauauauauauauauauauacacaaaugca

SEQ ID NO: 756865 - RNA, 64 nt, hsa
auucacacucuacauauauauauauauauauauauauauauauauauauauauauacacaaaug

SEQ ID NO: 756866 - RNA, 64 nt, hsa
auauucacacucuacauauauauauauauauauauauauauauauauauauauauauacacaaa

SEQ ID NO: 756867 - RNA, 64 nt, hsa
auauauucacacucuacauauauauauauauauauauauauauauauauauauauauauacaca

SEQ ID NO: 756868 - RNA, 64 nt, hsa
auauauauucacacucuacauauauauauauauauauauauauauauauauauauauauauaca

SEQ ID NO: 756869 - RNA, 64 nt, hsa
uuauauauauucacacucuacauauauauauauauauauauauauauauauauauauauauaua

SEQ ID NO: 756870 - RNA, 64 nt, hsa
acuuauauauauucacacucuacauauauauauauauauauauauauauauauauauauauaua

SEQ ID NO: 756871 - RNA, 64 nt, hsa
ccacuuauauauauucacacucuacauauauauauauauauauauauauauauauauauauaua

SEQ ID NO: 756872 - RNA, 64 nt, hsa
guccacuuauauauauucacacucuacauauauauauauauauauauauauauauauauauaua

SEQ ID NO: 756873 - RNA, 64 nt, hsa
acguccacuuauauauauucacacucuacauauauauauauauauauauauauauauauauaua

SEQ ID NO: 756874 - RNA, 64 nt, hsa
cuacguccacuuauauauauucacacucuacauauauauauauauauauauauauauauauaua

SEQ ID NO: 756875 - RNA, 64 nt, hsa
aacuacguccacuuauauauauucacacucuacauauauauauauauauauauauauauauaua

SEQ ID NO: 756876 - RNA, 64 nt, hsa
agaaggugcaguuuuauaacuaacuacguccacuuauauauauucacacucuacauauauauau

SEQ ID NO: 756877 - RNA, 64 nt, hsa
aaacugcaaaaaaauacguaauaaagaauacauauauauauaucuacacacaaauuauauaucu

SEQ ID NO: 756878 - RNA, 64 nt, hsa
aaaaacugcaaaaaaauacguaauaaagaauacauauauauauaucuacacacaaauuauauau

SEQ ID NO: 756879 - RNA, 64 nt, hsa
auuuuuauagacauauauaaauauauauauauuauauauauauuucuaaguguaacuguccuuc

SEQ ID NO: 756880 - RNA, 64 nt, hsa
aaauuuuuauagacauauauaaauauauauauauuauauauauauuucuaaguguaacuguccu

SEQ ID NO: 756881 - RNA, 64 nt, hsa
aagugugauaaauuuuuauagacauauauaaauauauauauauuauauauauauuucuaagugu

SEQ ID NO: 756882 - RNA, 64 nt, hsa
ucaagugugauaaauuuuuauagacauauauaaauauauauauauuauauauauauuucuaagu

SEQ ID NO: 756883 - RNA, 64 nt, hsa
aacaaaacuuuuuuuuauacauaauauauauauauauauauaaaauaacuuauuguaucagucc

SEQ ID NO: 756884 - RNA, 64 nt, hsa
uaaacaaaacuuuuuuuuauacauaauauauauauauauauauaaaauaacuuauuguaucagu

SEQ ID NO: 756885 - RNA, 64 nt, hsa
uguaaacaaaacuuuuuuuuauacauaauauauauauauauauauaaaauaacuuauuguauca

SEQ ID NO: 756886 - RNA, 64 nt, hsa
gauguaaacaaaacuuuuuuuuauacauaauauauauauauauauauaaaauaacuuauuguau

SEQ ID NO: 756887 - RNA, 64 nt, hsa
uugauguaaacaaaacuuuuuuuuauacauaauauauauauauauauauaaaauaacuuauugu

SEQ ID NO: 756888 - RNA, 64 nt, hsa
acuugauguaaacaaaacuuuuuuuuauacauaauauauauauauauauauaaaauaacuuauu

SEQ ID NO: 756889 - RNA, 64 nt, hsa
auaauauauacaaauauauauauauacauauauauauauauaguuauuuaaaaaaggcaacuga

SEQ ID NO: 756890 - RNA, 64 nt, hsa
ggauaauauauacaaauauauauauauacauauauauauauauaguuauuuaaaaaaggcaacu

SEQ ID NO: 756891 - RNA, 64 nt, hsa
caggauaauauauacaaauauauauauauacauauauauauauauaguuauuuaaaaaaggcaa

SEQ ID NO: 756892 - RNA, 64 nt, hsa
cacaggauaauauauacaaauauauauauauacauauauauauauauaguuauuuaaaaaaggc

SEQ ID NO: 756893 - RNA, 64 nt, hsa
uaaguagaaucacaggauaauauauacaaauauauauauauacauauauauauauauaguuauu

SEQ ID NO: 756894 - RNA, 64 nt, hsa
cauaaguagaaucacaggauaauauauacaaauauauauauauacauauauauauauauaguua

SEQ ID NO: 756895 - RNA, 64 nt, hsa
accauaaguagaaucacaggauaauauauacaaauauauauauauacauauauauauauauagu

SEQ ID NO: 756896 - RNA, 64 nt, hsa
uggggguggggggcggguuuuauaaauaaauauauauauauauguacauaggaaaaaccaaaua

SEQ ID NO: 756897 - RNA, 64 nt, hsa
cuuggggguggggggcggguuuuauaaauaaauauauauauauauguacauaggaaaaaccaaa

SEQ ID NO: 756898 - RNA, 64 nt, hsa
accuuggggguggggggcggguuuuauaaauaaauauauauauauauguacauaggaaaaacca

SEQ ID NO: 756899 - RNA, 64 nt, hsa
gauaaaaaacaaaguauacauauaugucuauauauauauauagacacacacacacagacauaua

SEQ ID NO: 756900 - RNA, 64 nt, hsa
uggauaaaaaacaaaguauacauauaugucuauauauauauauagacacacacacacagacaua

SEQ ID NO: 756901 - RNA, 64 nt, hsa
aauggauaaaaaacaaaguauacauauaugucuauauauauauauagacacacacacacagaca

SEQ ID NO: 756902 - RNA, 64 nt, hsa
cuaauggauaaaaaacaaaguauacauauaugucuauauauauauauagacacacacacacaga

SEQ ID NO: 756903 - RNA, 64 nt, hsa
aaauaccaccauccuuaacagaaacaaaaauauauauauauauuauuuuuaaaaauuagcauug

SEQ ID NO: 756904 - RNA, 64 nt, hsa
gcaaauaccaccauccuuaacagaaacaaaaauauauauauauauuauuuuuaaaaauuagcau

SEQ ID NO: 756905 - RNA, 64 nt, hsa
aagcaaauaccaccauccuuaacagaaacaaaaauauauauauauauuauuuuuaaaaauuagc

SEQ ID NO: 756906 - RNA, 64 nt, hsa
cuucucauuucugcuuucuuacuggacucaucuuuauauauaauguuaauaaaaaagacgaaaa

SEQ ID NO: 756907 - RNA, 64 nt, hsa
aaaaaaaaaaaggagagguagaagacuguagcuauauauauaaauauauaguaaguuuuuuuuu

SEQ ID NO: 756908 - RNA, 64 nt, hsa
aaaaaaaaaaaaaggagagguagaagacuguagcuauauauauaaauauauaguaaguuuuuuu

SEQ ID NO: 756909 - RNA, 64 nt, hsa
auuuaguacaaaguuuguaaaauaucagaggauauauauauauuguuucuacgacaugguauug

SEQ ID NO: 756910 - RNA, 64 nt, hsa
uaauuuaguacaaaguuuguaaaauaucagaggauauauauauauuguuucuacgacaugguau

SEQ ID NO: 756911 - RNA, 64 nt, hsa
uuuuacuaauaaacaaauuuuaaguauauauauauauauauaacuugaacuucauaaaugugaa

SEQ ID NO: 756912 - RNA, 64 nt, hsa
cauuuuacuaauaaacaaauuuuaaguauauauauauauauauaacuugaacuucauaaaugug

SEQ ID NO: 756913 - RNA, 64 nt, hsa
aacauuuuacuaauaaacaaauuuuaaguauauauauauauauauaacuugaacuucauaaaug

SEQ ID NO: 756914 - RNA, 64 nt, hsa
caaacauuuuacuaauaaacaaauuuuaaguauauauauauauauauaacuugaacuucauaaa

SEQ ID NO: 756915 - RNA, 64 nt, hsa
accaaacauuuuacuaauaaacaaauuuuaaguauauauauauauauauaacuugaacuucaua

SEQ ID NO: 756916 - RNA, 64 nt, hsa
agaccaaacauuuuacuaauaaacaaauuuuaaguauauauauauauauauaacuugaacuuca

SEQ ID NO: 756917 - RNA, 64 nt, hsa
auauacgagcuauauauaaauauauauauacauauauauauacacacauacauaucuagaaugu

SEQ ID NO: 756918 - RNA, 64 nt, hsa
cuauauacgagcuauauauaaauauauauauacauauauauauacacacauacauaucuagaau

SEQ ID NO: 756919 - RNA, 64 nt, hsa
cagauauauucuauauacgagcuauauauaaauauauauauacauauauauauacacacauaca

SEQ ID NO: 756920 - RNA, 64 nt, hsa
uacagauauauucuauauacgagcuauauauaaauauauauauacauauauauauacacacaua

SEQ ID NO: 756921 - RNA, 64 nt, hsa
cuaccauauauacagauauauucuauauacgagcuauauauaaauauauauauacauauauaua

SEQ ID NO: 756922 - RNA, 64 nt, hsa
cgcucaaauaccuucacaauaaauaguggcaauauauauauaguuuaagaaggcucuccauuug

SEQ ID NO: 756923 - RNA, 64 nt, hsa
gccgcucaaauaccuucacaauaaauaguggcaauauauauauaguuuaagaaggcucuccauu

SEQ ID NO: 756924 - RNA, 64 nt, hsa
ucaaaaggcccgaccaccccccuucgggcugcuauauauauauuuauuuguagguauuuauaua

SEQ ID NO: 756925 - RNA, 64 nt, hsa
gcucaaaaggcccgaccaccccccuucgggcugcuauauauauauuuauuuguagguauuuaua

SEQ ID NO: 756926 - RNA, 64 nt, hsa
acuuuguggaccaauuauugauauauauuauaaauauauauaaagaauauauauauauauauau

SEQ ID NO: 756927 - RNA, 64 nt, hsa
auuauugauauauauuauaaauauauauaaagaauauauauauauauauauauauaaaguauag

SEQ ID NO: 756928 - RNA, 64 nt, hsa
uauugauauauauuauaaauauauauaaagaauauauauauauauauauauauaaaguauagag

SEQ ID NO: 756929 - RNA, 64 nt, hsa
uugauauauauuauaaauauauauaaagaauauauauauauauauauauauaaaguauagagag

SEQ ID NO: 756930 - RNA, 64 nt, hsa
gauauauauuauaaauauauauaaagaauauauauauauauauauauauaaaguauagagagaa

SEQ ID NO: 756931 - RNA, 64 nt, hsa
uauauauuauaaauauauauaaagaauauauauauauauauauauauaaaguauagagagaagu

SEQ ID NO: 756932 - RNA, 64 nt, hsa
uauauuauaaauauauauaaagaauauauauauauauauauauauaaaguauagagagaaguuc

SEQ ID NO: 756933 - RNA, 64 nt, hsa
uauuauaaauauauauaaagaauauauauauauauauauauauaaaguauagagagaaguucau

SEQ ID NO: 756934 - RNA, 64 nt, hsa
auauaaagaauauauauauauauauauauauauauauauauaaaguauagagagaaguucauac

SEQ ID NO: 756935 - RNA, 64 nt, hsa
cugaaacuauaggaaagguuaauuugccuauaauuauauauacauuccauagucaucaaggaau

SEQ ID NO: 756936 - RNA, 64 nt, hsa
auugcagaagcugcaucaaaaguaugcuuugagguauauauagugaaacagagccuuucugaag

SEQ ID NO: 756937 - RNA, 64 nt, hsa
ucucaguuuagaaauuuauucaaagcuaaagauguauauauacauauacuuuuguguguauaua

SEQ ID NO: 756938 - RNA, 64 nt, hsa
gcuaaagauguauauauacauauacuuuuguguguauauauacacauauguguguaugcaguuu

SEQ ID NO: 756939 - RNA, 64 nt, hsa
auauacacauauguguguaugcaguuugucagguuauauauagaauuucuauuaaggauuuuuu

SEQ ID NO: 756940 - RNA, 64 nt, hsa
uggucuuuggagaaaaaauaauaaaacagaguguuauauauauauuuuuuggugcaagauaaga

SEQ ID NO: 756941 - RNA, 64 nt, hsa
gucuuuggagaaaaaauaauaaaacagaguguuauauauauauuuuuuggugcaagauaagauu

SEQ ID NO: 756942 - RNA, 64 nt, hsa
aaguguuauguuuguagauagagugaaauauauuuauauauauauaaauauauacagauacaua

SEQ ID NO: 756943 - RNA, 64 nt, hsa
guguuauguuuguagauagagugaaauauauuuauauauauauaaauauauacagauacauauc

SEQ ID NO: 756944 - RNA, 64 nt, hsa
guuauguuuguagauagagugaaauauauuuauauauauauaaauauauacagauacauaucug

SEQ ID NO: 756945 - RNA, 64 nt, hsa
cagaacagaaccccacagcuggauaaggcccguauauauauauuuguaagccuugcaaugugac

SEQ ID NO: 756946 - RNA, 64 nt, hsa
cacagaacagaaccccacagcuggauaaggcccguauauauauauuuguaagccuugcaaugug

SEQ ID NO: 756947 - RNA, 64 nt, hsa
gauauccucaagguguaaaaaauauauaaauauauauauauaugucaaaagguaggaaaugcaa

SEQ ID NO: 756948 - RNA, 64 nt, hsa
gugauauccucaagguguaaaaaauauauaaauauauauauauaugucaaaagguaggaaaugc

SEQ ID NO: 756949 - RNA, 64 nt, hsa
uagugauauccucaagguguaaaaaauauauaaauauauauauauaugucaaaagguaggaaau

SEQ ID NO: 756950 - RNA, 64 nt, hsa
uguucagauccaaaggauccguuguaaaaauauauauauauaaauauauguauauccagugcaa

SEQ ID NO: 756951 - RNA, 64 nt, hsa
uauguucagauccaaaggauccguuguaaaaauauauauauauaaauauauguauauccagugc

SEQ ID NO: 756952 - RNA, 64 nt, hsa
uguauguucagauccaaaggauccguuguaaaaauauauauauauaaauauauguauauccagu

SEQ ID NO: 756953 - RNA, 55 nt, hsa
caauccaaauucacucuuaacuauauauauauacauaaauacuauaucucuauau

SEQ ID NO: 756954 - RNA, 53 nt, hsa
caauccaaauucacucuuaacuauauauauauacauaaauacuauaucucuau

SEQ ID NO: 756955 - RNA, 51 nt, hsa
caauccaaauucacucuuaacuauauauauauacauaaauacuauaucucu

SEQ ID NO: 756956 - RNA, 64 nt, hsa
gccacagcugacgccaaaaagaaaagaaaaaagauauauauauauauauauauauauacacgua

SEQ ID NO: 756957 - RNA, 64 nt, hsa
cacagcugacgccaaaaagaaaagaaaaaagauauauauauauauauauauauauacacguaua

SEQ ID NO: 756958 - RNA, 64 nt, hsa
cagcugacgccaaaaagaaaagaaaaaagauauauauauauauauauauauauacacguauaua

SEQ ID NO: 756959 - RNA, 64 nt, hsa
gcugacgccaaaaagaaaagaaaaaagauauauauauauauauauauauauacacguauauaua

SEQ ID NO: 756960 - RNA, 64 nt, hsa
ugacgccaaaaagaaaagaaaaaagauauauauauauauauauauauauacacguauauauaua

SEQ ID NO: 756961 - RNA, 64 nt, hsa
acgccaaaaagaaaagaaaaaagauauauauauauauauauauauauacacguauauauauaaa

SEQ ID NO: 756962 - RNA, 64 nt, hsa
gccaaaaagaaaagaaaaaagauauauauauauauauauauauauacacguauauauauaaaga

SEQ ID NO: 756963 - RNA, 64 nt, hsa
caaaaagaaaagaaaaaagauauauauauauauauauauauauacacguauauauauaaagaga

SEQ ID NO: 756964 - RNA, 64 nt, hsa
aaaagaaaagaaaaaagauauauauauauauauauauauauacacguauauauauaaagagaau

SEQ ID NO: 756965 - RNA, 64 nt, hsa
aaaagauauauauauauauauauauauauacacguauauauauaaagagaauuuaauaaaacag

SEQ ID NO: 756966 - RNA, 64 nt, hsa
aagauauauauauauauauauauauauacacguauauauauaaagagaauuuaauaaaacaggg

SEQ ID NO: 756967 - RNA, 64 nt, hsa
auauuuauucugagccugagcucagauaauauauuauauauauuauauauauauauauauuucu

SEQ ID NO: 756968 - RNA, 64 nt, hsa
cugagccugagcucagauaauauauuauauauauuauauauauauauauauuucuauuuaaaga

SEQ ID NO: 756969 - RNA, 64 nt, hsa
gagccugagcucagauaauauauuauauauauuauauauauauauauauuucuauuuaaagagg

SEQ ID NO: 756970 - RNA, 64 nt, hsa
gccugagcucagauaauauauuauauauauuauauauauauauauauuucuauuuaaagaggau

SEQ ID NO: 756971 - RNA, 64 nt, hsa
cugagcucagauaauauauuauauauauuauauauauauauauauuucuauuuaaagaggaucc

SEQ ID NO: 756972 - RNA, 64 nt, hsa
gagcucagauaauauauuauauauauuauauauauauauauauuucuauuuaaagaggauccug

SEQ ID NO: 756973 - RNA, 64 nt, hsa
ugcacuuuguauauugguugaaacuguuaucacuuauauauauauauauacacacauauauaua

SEQ ID NO: 756974 - RNA, 64 nt, hsa
cacuuuguauauugguugaaacuguuaucacuuauauauauauauauacacacauauauauaaa

SEQ ID NO: 756975 - RNA, 64 nt, hsa
cuuuguauauugguugaaacuguuaucacuuauauauauauauauacacacauauauauaaaau

SEQ ID NO: 756976 - RNA, 64 nt, hsa
uuguauauugguugaaacuguuaucacuuauauauauauauauacacacauauauauaaaaucu

SEQ ID NO: 756977 - RNA, 64 nt, hsa
guauauugguugaaacuguuaucacuuauauauauauauauacacacauauauauaaaaucuau

SEQ ID NO: 756978 - RNA, 64 nt, hsa
acuguuaucacuuauauauauauauauacacacauauauauaaaaucuauuuauuuuugcaaac

SEQ ID NO: 756979 - RNA, 64 nt, hsa
uuuugaaaacaugaccaaacucauacuucaaaaauauauauauaaugaaugugaggaauaugaa

SEQ ID NO: 756980 - RNA, 64 nt, hsa
uugaaaacaugaccaaacucauacuucaaaaauauauauauaaugaaugugaggaauaugaaaa

SEQ ID NO: 756981 - RNA, 64 nt, hsa
cccuuauuccaugaaaguuuuauaaaagaaaaaauauauauauauucauguuuauuuaagaaau

SEQ ID NO: 756982 - RNA, 64 nt, hsa
cuuauuccaugaaaguuuuauaaaagaaaaaauauauauauauucauguuuauuuaagaaaugg

SEQ ID NO: 756983 - RNA, 64 nt, hsa
agccugggagacagagugagacuccaucucaaaauauauauauauuuccaaauauucaguuugg

SEQ ID NO: 756984 - RNA, 64 nt, hsa
ccugggagacagagugagacuccaucucaaaauauauauauauuuccaaauauucaguuugguc

SEQ ID NO: 756985 - RNA, 64 nt, hsa
uauguucucguuuuucuacagauauaaguaaauuuauauauaaaaauaccaaaaagaggcuggg

SEQ ID NO: 756986 - RNA, 64 nt, hsa
gagauuccgucucaacaagaaaaaaaaaaaagaauauauauauauguauguauguauguaugua

SEQ ID NO: 756987 - RNA, 64 nt, hsa
gauuccgucucaacaagaaaaaaaaaaaagaauauauauauauguauguauguauguauguaaa

SEQ ID NO: 756988 - RNA, 64 nt, hsa
caagacaaaaggacucuguaauuccacuucuagguauauauacauccuauagaaacucacaaau

SEQ ID NO: 756989 - RNA, 64 nt, hsa
auccuauagaaacucacaaauaaugcauaagaaauauauauauaauauauguauguauguauag

SEQ ID NO: 756990 - RNA, 64 nt, hsa
ccuauagaaacucacaaauaaugcauaagaaauauauauauaauauauguauguauguauagcc

SEQ ID NO: 756991 - RNA, 64 nt, hsa
gugagauuaucgaaaauuauaauauacaaaaucauauauauauauauguucuuguuuuuugaga

SEQ ID NO: 756992 - RNA, 64 nt, hsa
gagauuaucgaaaauuauaauauacaaaaucauauauauauauauguucuuguuuuuugagaca

SEQ ID NO: 756993 - RNA, 64 nt, hsa
gauuaucgaaaauuauaauauacaaaaucauauauauauauauguucuuguuuuuugagacaga

SEQ ID NO: 756994 - RNA, 64 nt, hsa
ggauuacaggcgugagucaccgugcccagccauguauauauauaauuuuaaaaauuaagcugaa

SEQ ID NO: 756995 - RNA, 64 nt, hsa
auuacaggcgugagucaccgugcccagccauguauauauauaauuuuaaaaauuaagcugaaau

SEQ ID NO: 756996 - RNA, 64 nt, hsa
ccuucaaaguuuugguuuuuuuaagaaaaaaaaauauauauauauuuggguuuugggggaaaag

SEQ ID NO: 756997 - RNA, 64 nt, hsa
uucaaaguuuugguuuuuuuaagaaaaaaaaauauauauauauuuggguuuugggggaaaaggg

SEQ ID NO: 756998 - RNA, 64 nt, hsa
uagcacuuuagaguccaugaaauaugguaaaaaauauauauauaucauaauaaaugacagcuga

SEQ ID NO: 756999 - RNA, 64 nt, hsa
gcacuuuagaguccaugaaauaugguaaaaaauauauauauaucauaauaaaugacagcugaug

SEQ ID NO: 757000 - RNA, 64 nt, hsa
uuaugugugugugugcgccuuauguauauaagcauauauauaauauauaagcauauuauuauau

SEQ ID NO: 757001 - RNA, 64 nt, hsa
ccuguauguacguauauuucuguaucuauguauguauauauaugcauaugcagacauauguaua

SEQ ID NO: 757002 - RNA, 64 nt, hsa
ugugcaguguacuuccccuuuaaauuaaaaaacauauauauauauauauuuggaggucaguaau

SEQ ID NO: 757003 - RNA, 64 nt, hsa
ugcaguguacuuccccuuuaaauuaaaaaacauauauauauauauauuuggaggucaguaauuu

SEQ ID NO: 757004 - RNA, 64 nt, hsa
caguguacuuccccuuuaaauuaaaaaacauauauauauauauauuuggaggucaguaauuucc

SEQ ID NO: 757005 - RNA, 64 nt, hsa
guguacuuccccuuuaaauuaaaaaacauauauauauauauauuuggaggucaguaauuuccaa

SEQ ID NO: 757006 - RNA, 64 nt, hsa
ucaagaagaaaaaaaaaauacauauacacauaaauauauauauguguguguguauauauauaua

SEQ ID NO: 757007 - RNA, 64 nt, hsa
uacauauacacauaaauauauauauguguguguguauauauauauauauauauauauaugcuau

SEQ ID NO: 757008 - RNA, 64 nt, hsa
cauauacacauaaauauauauauguguguguguauauauauauauauauauauauaugcuauau

SEQ ID NO: 757009 - RNA, 64 nt, hsa
uauacacauaaauauauauauguguguguguauauauauauauauauauauauaugcuauauaa

SEQ ID NO: 757010 - RNA, 64 nt, hsa
uacacauaaauauauauauguguguguguauauauauauauauauauauauaugcuauauaaag

SEQ ID NO: 757011 - RNA, 64 nt, hsa
cacauaaauauauauauguguguguguauauauauauauauauauauauaugcuauauaaaguu

SEQ ID NO: 757012 - RNA, 64 nt, hsa
cauaaauauauauauguguguguguauauauauauauauauauauauaugcuauauaaaguuua

SEQ ID NO: 757013 - RNA, 64 nt, hsa
uaaauauauauauguguguguguauauauauauauauauauauauaugcuauauaaaguuuaaa

SEQ ID NO: 757014 - RNA, 64 nt, hsa
aauauauauauguguguguguauauauauauauauauauauauaugcuauauaaaguuuaaaug

SEQ ID NO: 757015 - RNA, 64 nt, hsa
uauauauauguguguguguauauauauauauauauauauauaugcuauauaaaguuuaaaugaa

SEQ ID NO: 757016 - RNA, 64 nt, hsa
ccuuaaaaacaaaauuuauauauagauauauauauauauauaaauaauauacuuuuccucagag

SEQ ID NO: 757017 - RNA, 64 nt, hsa
cuccuuaaaaacaaaauuuauauauagauauauauauauauauaaauaauauacuuuuccucag

SEQ ID NO: 757018 - RNA, 64 nt, hsa
uccuccuuaaaaacaaaauuuauauauagauauauauauauauauaaauaauauacuuuuccuc

SEQ ID NO: 757019 - RNA, 64 nt, hsa
uuuccuccuuaaaaacaaaauuuauauauagauauauauauauauauaaauaauauacuuuucc

SEQ ID NO: 757020 - RNA, 64 nt, hsa
ucuuuccuccuuaaaaacaaaauuuauauauagauauauauauauauauaaauaauauacuuuu

SEQ ID NO: 757021 - RNA, 64 nt, hsa
uuuuuuuuucucuuuccuccuuaaaaacaaaauuuauauauagauauauauauauauauaaaua

SEQ ID NO: 757022 - RNA, 64 nt, hsa
cagauaucuauaucuauauauauauauacagauauauauauaugacgcgucacagaaucuaggg

SEQ ID NO: 757023 - RNA, 64 nt, hsa
uacagauaucuauaucuauauauauauauacagauauauauauaugacgcgucacagaaucuag

SEQ ID NO: 757024 - RNA, 64 nt, hsa
aaucuaucuauauacagauaucuauaucuauauauauauauacagauauauauauaugacgcgu

SEQ ID NO: 757025 - RNA, 64 nt, hsa
aaaaucuaucuauauacagauaucuauaucuauauauauauauacagauauauauauaugacgc

SEQ ID NO: 757026 - RNA, 64 nt, hsa
agaaaaucuaucuauauacagauaucuauaucuauauauauauauacagauauauauauaugac

SEQ ID NO: 757027 - RNA, 64 nt, hsa
aaagaaaaucuaucuauauacagauaucuauaucuauauauauauauacagauauauauauaug

SEQ ID NO: 757028 - RNA, 64 nt, hsa
acaaagagcaaagcagaacuuauaaaauuauauauauauauauuaaaaagucucuauucuucac

SEQ ID NO: 757029 - RNA, 64 nt, hsa
acacaaagagcaaagcagaacuuauaaaauuauauauauauauauuaaaaagucucuauucuuc

SEQ ID NO: 757030 - RNA, 64 nt, hsa
aaacacaaagagcaaagcagaacuuauaaaauuauauauauauauauuaaaaagucucuauucu

SEQ ID NO: 757031 - RNA, 64 nt, hsa
aaaaacacaaagagcaaagcagaacuuauaaaauuauauauauauauauuaaaaagucucuauu

SEQ ID NO: 757032 - RNA, 64 nt, hsa
uguguguguguguguauguguauauauauauacauauauauacacauauguauguauaccuaac

SEQ ID NO: 757033 - RNA, 64 nt, hsa
uguguguguguguguguguguguguauguguauauauauauacauauauauacacauauguaug

SEQ ID NO: 757034 - RNA, 64 nt, hsa
acuguguguguguguguguguguguguauguguauauauauauacauauauauacacauaugua

SEQ ID NO: 757035 - RNA, 64 nt, hsa
ucacuguguguguguguguguguguguguauguguauauauauauacauauauauacacauaug

SEQ ID NO: 757036 - RNA, 64 nt, hsa
uauauuugucuagagggcuguguguauauauauuuauauauauuuuuaaauauggaaugcuuuu

SEQ ID NO: 757037 - RNA, 64 nt, hsa
gugauuuuuguauauuugucuagagggcuguguguauauauauuuauauauauuuuuaaauaug

SEQ ID NO: 757038 - RNA, 64 nt, hsa
gccauagauagaagguaucuguaauauauauauauauauauaaaaugaaauauauguuucauuu

SEQ ID NO: 757039 - RNA, 64 nt, hsa
uugccauagauagaagguaucuguaauauauauauauauauauaaaaugaaauauauguuucau

SEQ ID NO: 757040 - RNA, 64 nt, hsa
aauugccauagauagaagguaucuguaauauauauauauauauauaaaaugaaauauauguuuc

SEQ ID NO: 757041 - RNA, 64 nt, hsa
uaaauugccauagauagaagguaucuguaauauauauauauauauauaaaaugaaauauauguu

SEQ ID NO: 757042 - RNA, 64 nt, hsa
cauaaauugccauagauagaagguaucuguaauauauauauauauauauaaaaugaaauauaug

SEQ ID NO: 757043 - RNA, 64 nt, hsa
aacauaaauugccauagauagaagguaucuguaauauauauauauauauauaaaaugaaauaua

SEQ ID NO: 757044 - RNA, 64 nt, hsa
cacacacacacacacacacacacacauauauauauauauauauuuuuuuuuuuuuccugaggau

SEQ ID NO: 757045 - RNA, 64 nt, hsa
cacacacacacacacacacacacacacauauauauauauauauauuuuuuuuuuuuuccugagg

SEQ ID NO: 757046 - RNA, 64 nt, hsa
cacacacacacacacacacacacacacacauauauauauauauauauuuuuuuuuuuuuccuga

SEQ ID NO: 757047 - RNA, 64 nt, hsa
cacacacacacacacacacacacacacacacauauauauauauauauauuuuuuuuuuuuuccu

SEQ ID NO: 757048 - RNA, 64 nt, hsa
cacacacacacacacacacacacacacacacacauauauauauauauauauuuuuuuuuuuuuc

SEQ ID NO: 757049 - RNA, 64 nt, hsa
agauauguauauauauauauauauuauauauauauauauauacacacacacacacacacacaca

SEQ ID NO: 757050 - RNA, 64 nt, hsa
uaagauauguauauauauauauauauuauauauauauauauauacacacacacacacacacaca

SEQ ID NO: 757051 - RNA, 64 nt, hsa
uauaagauauguauauauauauauauauuauauauauauauauauacacacacacacacacaca

SEQ ID NO: 757052 - RNA, 64 nt, hsa
cauauaagauauguauauauauauauauauuauauauauauauauauacacacacacacacaca

SEQ ID NO: 757053 - RNA, 64 nt, hsa
ugcauauaagauauguauauauauauauauauuauauauauauauauauacacacacacacaca

SEQ ID NO: 757054 - RNA, 64 nt, hsa
ugugcauauaagauauguauauauauauauauauuauauauauauauauauacacacacacaca

SEQ ID NO: 757055 - RNA, 64 nt, hsa
cuagagggcugugcauauaagauauguauauauauauauauauuauauauauauauauauacac

SEQ ID NO: 757056 - RNA, 64 nt, hsa
uccuagagggcugugcauauaagauauguauauauauauauauauuauauauauauauauauac

SEQ ID NO: 757057 - RNA, 64 nt, hsa
ucuccuagagggcugugcauauaagauauguauauauauauauauauuauauauauauauauau

SEQ ID NO: 757058 - RNA, 64 nt, hsa
cuucuccuagagggcugugcauauaagauauguauauauauauauauauuauauauauauauau

SEQ ID NO: 757059 - RNA, 64 nt, hsa
cucuucuccuagagggcugugcauauaagauauguauauauauauauauauuauauauauauau

SEQ ID NO: 757060 - RNA, 64 nt, hsa
auggaaagcaaagcuguggauaagggggaacuacuauauauaugcaucuacccaagaaacauga

SEQ ID NO: 757061 - RNA, 64 nt, hsa
gauaggaccaaacucuaugucuauguuuuuuucuuauauauacauaccuaugauaaaauuuagu

SEQ ID NO: 757062 - RNA, 64 nt, hsa
uauauaguauauacacuauauacugggcacuauauauauauaguguguauguguguuauauugg

SEQ ID NO: 757063 - RNA, 64 nt, hsa
uauauauaguauauacacuauauacugggcacuauauauauauaguguguauguguguuauauu

SEQ ID NO: 757064 - RNA, 64 nt, hsa
uguauauauaguauauacacuauauacugggcacuauauauauauaguguguauguguguuaua

SEQ ID NO: 757065 - RNA, 64 nt, hsa
auauauauauacacacacacacacacaauauauguauauauaguauauacacuauauacugggc

SEQ ID NO: 757066 - RNA, 64 nt, hsa
acacaugcacuacauaacacacuauauauauauauauauauacacacacacacacacaauauau

SEQ ID NO: 757067 - RNA, 64 nt, hsa
ccacacaugcacuacauaacacacuauauauauauauauauauacacacacacacacacaauau

SEQ ID NO: 757068 - RNA, 64 nt, hsa
gcccacacaugcacuacauaacacacuauauauauauauauauauacacacacacacacacaau

SEQ ID NO: 757069 - RNA, 64 nt, hsa
augcccacacaugcacuacauaacacacuauauauauauauauauauacacacacacacacaca

SEQ ID NO: 757070 - RNA, 64 nt, hsa
auaugcccacacaugcacuacauaacacacuauauauauauauauauauacacacacacacaca

SEQ ID NO: 757071 - RNA, 64 nt, hsa
auauaugcccacacaugcacuacauaacacacuauauauauauauauauauacacacacacaca

SEQ ID NO: 757072 - RNA, 64 nt, hsa
cuauauaugcccacacaugcacuacauaacacacuauauauauauauauauauacacacacaca

SEQ ID NO: 757073 - RNA, 64 nt, hsa
accauauauguauauauuccacauauguauuccauauauauauuccauauguauaugugugugu

SEQ ID NO: 757074 - RNA, 64 nt, hsa
auuucuuaacaaaaugauggccaagguaguuccauauauauacauauauuccacauguguguau

SEQ ID NO: 757075 - RNA, 64 nt, hsa
ggugucgcuaguacagcaaaauuaaauacauaaauauauauauauauauauauuuuagaaaaaa

SEQ ID NO: 757076 - RNA, 62 nt, hsa
ugucgcuaguacagcaaaauuaaauacauaaauauauauauauauauauauuuuagaaaaaa

SEQ ID NO: 757077 - RNA, 64 nt, hsa
ucaagacuuuuagcauaaugaaaaacccucucucuauauauauauguguauaugaauuaugugg

SEQ ID NO: 757078 - RNA, 64 nt, hsa
aagacuuuuagcauaaugaaaaacccucucucuauauauauauguguauaugaauuaugugggc

SEQ ID NO: 757079 - RNA, 64 nt, hsa
uaugugugcauguguguauaagugcacacagaaauauauauacauauguagacuauauacaugu

SEQ ID NO: 757080 - RNA, 64 nt, hsa
auauguagacuauauacauguguguauauauguguauauauacauacacuuguauaaauguaua

SEQ ID NO: 757081 - RNA, 64 nt, hsa
gcaaguuuugauaugaguauacaauauauaaaaauauauauagugcuauauauauaaauauuug

SEQ ID NO: 757082 - RNA, 64 nt, hsa
augaguauacaauauauaaaaauauauauagugcuauauauauaaauauuuggucucuauuuca

SEQ ID NO: 757083 - RNA, 64 nt, hsa
gaguauacaauauauaaaaauauauauagugcuauauauauaaauauuuggucucuauuucauu

SEQ ID NO: 757084 - RNA, 64 nt, hsa
cugucacugaugagagacugggaagggaaaagcauauauauauagauauauagagauauagaua

SEQ ID NO: 757085 - RNA, 64 nt, hsa
gucacugaugagagacugggaagggaaaagcauauauauauagauauauagagauauagauaua

SEQ ID NO: 757086 - RNA, 64 nt, hsa
aaagcauauauauauagauauauagagauauagauauauauacaggaaacaccgcauccuugca

SEQ ID NO: 757087 - RNA, 64 nt, hsa
uucuggaagacuuuuaaaaaaauauaaauaugcauauauauauauaaauuauaaauagauuccc

SEQ ID NO: 757088 - RNA, 64 nt, hsa
cuggaagacuuuuaaaaaaauauaaauaugcauauauauauauaaauuauaaauagauucccca

SEQ ID NO: 757089 - RNA, 64 nt, hsa
ggaagacuuuuaaaaaaauauaaauaugcauauauauauauaaauuauaaauagauuccccacg

SEQ ID NO: 757090 - RNA, 64 nt, hsa
gguguuugugaaaauccuauaagauuuaaagaaauauauauauacuuuuuuucuuuuuucuuuu

SEQ ID NO: 757091 - RNA, 64 nt, hsa
uguuugugaaaauccuauaagauuuaaagaaauauauauauacuuuuuuucuuuuuucuuuuuu

SEQ ID NO: 757092 - RNA, 64 nt, hsa
guuucuuaaaaaacauauauguguguggcguguguauauauauguauauauauuuuuucauugu

SEQ ID NO: 757093 - RNA, 64 nt, hsa
aaacauauauguguguggcguguguauauauauguauauauauuuuuucauuguauuauuacgg

SEQ ID NO: 757094 - RNA, 64 nt, hsa
cgcggggagcccgucgguaauuuuaauauuuuauuauauauauauaucuauauuuuuguccaaa

SEQ ID NO: 757095 - RNA, 64 nt, hsa
cggggagcccgucgguaauuuuaauauuuuauuauauauauauaucuauauuuuuguccaaacc

SEQ ID NO: 757096 - RNA, 64 nt, hsa
gggagcccgucgguaauuuuaauauuuuauuauauauauauaucuauauuuuuguccaaaccaa

SEQ ID NO: 757097 - RNA, 64 nt, hsa
agcuagaaugcacaccaaaaaaauacuugagcuguauauauauaugugugugugugugugugug

SEQ ID NO: 757098 - RNA, 64 nt, hsa
cuagaaugcacaccaaaaaaauacuugagcuguauauauauaugugugugugugugugugugug

SEQ ID NO: 757099 - RNA, 64 nt, hsa
cuuguuacagccccgccaccccuugcuguguguauauauauaauacuuuguccuucauauguga

SEQ ID NO: 757100 - RNA, 64 nt, hsa
cucuuguuacagccccgccaccccuugcuguguguauauauauaauacuuuguccuucauaugu

SEQ ID NO: 757101 - RNA, 64 nt, hsa
gggacguccaaccacaaaagaaauuauauauaaauauauauaaauauauaucucuaccauaugu

SEQ ID NO: 757102 - RNA, 64 nt, hsa
acucagcuuugggacguccaaccacaaaagaaauuauauauaaauauauauaaauauauaucuc

SEQ ID NO: 757103 - RNA, 64 nt, hsa
guugaccucuuucucuguagaaaugaaaacuaaauauauauaauugagaaauaauucugauacu

SEQ ID NO: 757104 - RNA, 64 nt, hsa
uguaguuuuuaaauuuggggaaugcaaauauauauauauauacacacacacacacacacauaca

SEQ ID NO: 757105 - RNA, 64 nt, hsa
auuguaguuuuuaaauuuggggaaugcaaauauauauauauauacacacacacacacacacaua

SEQ ID NO: 757106 - RNA, 64 nt, hsa
aaauuguaguuuuuaaauuuggggaaugcaaauauauauauauauacacacacacacacacaca

SEQ ID NO: 757107 - RNA, 64 nt, hsa
ccaaauuguaguuuuuaaauuuggggaaugcaaauauauauauauauacacacacacacacaca

SEQ ID NO: 757108 - RNA, 64 nt, hsa
gucuuuuaaaauaaguauuuccuauuaaacuauauauauauacagugccuuuuugguguuguga

SEQ ID NO: 757109 - RNA, 64 nt, hsa
cagucuuuuaaaauaaguauuuccuauuaaacuauauauauauacagugccuuuuugguguugu

SEQ ID NO: 757110 - RNA, 64 nt, hsa
gucagucuuuuaaaauaaguauuuccuauuaaacuauauauauauacagugccuuuuugguguu

SEQ ID NO: 757111 - RNA, 64 nt, hsa
caagaguaaaacuccaucucaaaaaauauauauauauauauaaauagggaauuuuuuuuaaugu

SEQ ID NO: 757112 - RNA, 64 nt, hsa
aacaagaguaaaacuccaucucaaaaaauauauauauauauauaaauagggaauuuuuuuuaau

SEQ ID NO: 757113 - RNA, 64 nt, hsa
gcaacaagaguaaaacuccaucucaaaaaauauauauauauauauaaauagggaauuuuuuuua

SEQ ID NO: 757114 - RNA, 64 nt, hsa
gggcaacaagaguaaaacuccaucucaaaaaauauauauauauauauaaauagggaauuuuuuu

SEQ ID NO: 757115 - RNA, 64 nt, hsa
cugggcaacaagaguaaaacuccaucucaaaaaauauauauauauauauaaauagggaauuuuu

SEQ ID NO: 757116 - RNA, 64 nt, hsa
aguguuuauauacgugcagauuaauuuauauauauauauauacacacacacauauacaguauaa

SEQ ID NO: 757117 - RNA, 64 nt, hsa
uuaguguuuauauacgugcagauuaauuuauauauauauauauacacacacacauauacaguau

SEQ ID NO: 757118 - RNA, 64 nt, hsa
uuuuaguguuuauauacgugcagauuaauuuauauauauauauauacacacacacauauacagu

SEQ ID NO: 757119 - RNA, 64 nt, hsa
ccuuuuaguguuuauauacgugcagauuaauuuauauauauauauauacacacacacauauaca

SEQ ID NO: 757120 - RNA, 64 nt, hsa
cuccuuuuaguguuuauauacgugcagauuaauuuauauauauauauauacacacacacauaua

SEQ ID NO: 757121 - RNA, 64 nt, hsa
uauauauauauauauauauauauauauauauauauauauauaucuaucugguagaucacaugua

SEQ ID NO: 757122 - RNA, 64 nt, hsa
uauauauauauauauauauauauauauauauauauauauauauaucuaucugguagaucacaug

SEQ ID NO: 757123 - RNA, 64 nt, hsa
uauauauauauauauauauauauauauauauauauauauauauauaucuaucugguagaucaca

SEQ ID NO: 757124 - RNA, 64 nt, hsa
uauauauauauauauauauauauauauauauauauauauauauauauaucuaucugguagauca

SEQ ID NO: 757125 - RNA, 64 nt, hsa
aauauauauauauauauauauauauauauauauauauauauauauauauaucuaucugguagau

SEQ ID NO: 757126 - RNA, 64 nt, hsa
uuaauauauauauauauauauauauauauauauauauauauauauauauauaucuaucugguag

SEQ ID NO: 757127 - RNA, 64 nt, hsa
uuuuaauauauauauauauauauauauauauauauauauauauauauauauauaucuaucuggu

SEQ ID NO: 757128 - RNA, 64 nt, hsa
cuuuuuaauauauauauauauauauauauauauauauauauauauauauauauauaucuaucug

SEQ ID NO: 757129 - RNA, 64 nt, hsa
cucuuuuuaauauauauauauauauauauauauauauauauauauauauauauauauaucuauc

SEQ ID NO: 757130 - RNA, 64 nt, hsa
cucucuuuuuaauauauauauauauauauauauauauauauauauauauauauauauauaucua

SEQ ID NO: 757131 - RNA, 64 nt, hsa
ggcucucuuuuuaauauauauauauauauauauauauauauauauauauauauauauauauauc

SEQ ID NO: 757132 - RNA, 64 nt, hsa
auggcucucuuuuuaauauauauauauauauauauauauauauauauauauauauauauauaua

SEQ ID NO: 757133 - RNA, 64 nt, hsa
cuauggcucucuuuuuaauauauauauauauauauauauauauauauauauauauauauauaua

SEQ ID NO: 757134 - RNA, 64 nt, hsa
uucuauggcucucuuuuuaauauauauauauauauauauauauauauauauauauauauauaua

SEQ ID NO: 757135 - RNA, 64 nt, hsa
ucuucuauggcucucuuuuuaauauauauauauauauauauauauauauauauauauauauaua

SEQ ID NO: 757136 - RNA, 64 nt, hsa
aaucuucuauggcucucuuuuuaauauauauauauauauauauauauauauauauauauauaua

SEQ ID NO: 757137 - RNA, 64 nt, hsa
caaaucuucuauggcucucuuuuuaauauauauauauauauauauauauauauauauauauaua

SEQ ID NO: 757138 - RNA, 64 nt, hsa
uccaaaucuucuauggcucucuuuuuaauauauauauauauauauauauauauauauauauaua

SEQ ID NO: 757139 - RNA, 64 nt, hsa
uuuccaaaucuucuauggcucucuuuuuaauauauauauauauauauauauauauauauauaua

SEQ ID NO: 757140 - RNA, 64 nt, hsa
guuuuccaaaucuucuauggcucucuuuuuaauauauauauauauauauauauauauauauaua

SEQ ID NO: 757141 - RNA, 64 nt, hsa
agguuuuccaaaucuucuauggcucucuuuuuaauauauauauauauauauauauauauauaua

SEQ ID NO: 757142 - RNA, 64 nt, hsa
uuuguuuaaagaucugcaauauuauauauauaaauauauauaagauaagagaaacuguaugugc

SEQ ID NO: 757143 - RNA, 64 nt, hsa
gcacaaaaccuuuguuuaaagaucugcaauauuauauauauaaauauauauaagauaagagaaa

SEQ ID NO: 757144 - RNA, 64 nt, hsa
uugcacaaaaccuuuguuuaaagaucugcaauauuauauauauaaauauauauaagauaagaga

SEQ ID NO: 757145 - RNA, 64 nt, hsa
aauaagggcuauuguaaaauuuaaaagaaauauuuauauauacacauauauacacauacacaca

SEQ ID NO: 757146 - RNA, 64 nt, hsa
uuuauauauacacauauauacacauacacacauguauauauauauucuucauaauggaggacaa

SEQ ID NO: 757147 - RNA, 64 nt, hsa
uauauauacacauauauacacauacacacauguauauauauauucuucauaauggaggacaaug

SEQ ID NO: 757148 - RNA, 64 nt, hsa
uaauuuuauauuaauauauaauacagauuaacauuauauauaauauguaccugugucacuucug

SEQ ID NO: 757149 - RNA, 64 nt, hsa
aaccuggguaacauggccagaccccaucucuauuuauauauauauauauaaaacuuagaguuuu

SEQ ID NO: 757150 - RNA, 64 nt, hsa
ccuggguaacauggccagaccccaucucuauuuauauauauauauauaaaacuuagaguuuuua

SEQ ID NO: 757151 - RNA, 64 nt, hsa
uggguaacauggccagaccccaucucuauuuauauauauauauauaaaacuuagaguuuuuauc

SEQ ID NO: 757152 - RNA, 64 nt, hsa
gguaacauggccagaccccaucucuauuuauauauauauauauaaaacuuagaguuuuuaucuu

SEQ ID NO: 757153 - RNA, 64 nt, hsa
uaacauggccagaccccaucucuauuuauauauauauauauaaaacuuagaguuuuuaucuucc

SEQ ID NO: 757154 - RNA, 64 nt, hsa
uuguauuugaagauauauggauacagauuauauauauauauacauauuuuccuuaauagaggaa

SEQ ID NO: 757155 - RNA, 64 nt, hsa
cauuguauuugaagauauauggauacagauuauauauauauauacauauuuuccuuaauagagg

SEQ ID NO: 757156 - RNA, 64 nt, hsa
cccauuguauuugaagauauauggauacagauuauauauauauauacauauuuuccuuaauaga

SEQ ID NO: 757157 - RNA, 64 nt, hsa
uacccauuguauuugaagauauauggauacagauuauauauauauauacauauuuuccuuaaua

SEQ ID NO: 757158 - RNA, 64 nt, hsa
auauauauauauauauauauauaauauguauauauauauauauugacuuguuacaugaagaugu

SEQ ID NO: 757159 - RNA, 64 nt, hsa
auauauauauauauauauauauauaauauguauauauauauauauugacuuguuacaugaagau

SEQ ID NO: 757160 - RNA, 64 nt, hsa
auauauauauauauauauauauauauaauauguauauauauauauauugacuuguuacaugaag

SEQ ID NO: 757161 - RNA, 64 nt, hsa
uuauauauauauauauauauauauauauaauauguauauauauauauauugacuuguuacauga

SEQ ID NO: 757162 - RNA, 64 nt, hsa
gagaguauauauuuuauauauauauauauauauauauauauaauauguauauauauauauauug

SEQ ID NO: 757163 - RNA, 64 nt, hsa
gugagaguauauauuuuauauauauauauauauauauauauauaauauguauauauauauauau

SEQ ID NO: 757164 - RNA, 64 nt, hsa
uggugagaguauauauuuuauauauauauauauauauauauauauaauauguauauauauauau

SEQ ID NO: 757165 - RNA, 64 nt, hsa
acuggugagaguauauauuuuauauauauauauauauauauauauauaauauguauauauauau

SEQ ID NO: 757166 - RNA, 64 nt, hsa
aaacuggugagaguauauauuuuauauauauauauauauauauauauauaauauguauauauau

SEQ ID NO: 757167 - RNA, 64 nt, hsa
guaaacuggugagaguauauauuuuauauauauauauauauauauauauauaauauguauauau

SEQ ID NO: 757168 - RNA, 64 nt, hsa
gaguaaacuggugagaguauauauuuuauauauauauauauauauauauauauaauauguauau

SEQ ID NO: 757169 - RNA, 64 nt, hsa
aagaguaaacuggugagaguauauauuuuauauauauauauauauauauauauauaauauguau

SEQ ID NO: 757170 - RNA, 64 nt, hsa
agaagaguaaacuggugagaguauauauuuuauauauauauauauauauauauauauaauaugu

SEQ ID NO: 757171 - RNA, 64 nt, hsa
acagaagaguaaacuggugagaguauauauuuuauauauauauauauauauauauauauaauau

SEQ ID NO: 757172 - RNA, 64 nt, hsa
uuacagaagaguaaacuggugagaguauauauuuuauauauauauauauauauauauauauaau

SEQ ID NO: 757173 - RNA, 64 nt, hsa
cuuauuuaaaacaacuuguuuuugaguuuucuuauauauauauugauuauuuguuuuacacaca

SEQ ID NO: 757174 - RNA, 64 nt, hsa
gacuuauuuaaaacaacuuguuuuugaguuuucuuauauauauauugauuauuuguuuuacaca

SEQ ID NO: 757175 - RNA, 64 nt, hsa
gggugguuuuuauuuuuauauacguuuauauaaauauauauaaauugagcuugcuucuuucuug

SEQ ID NO: 757176 - RNA, 64 nt, hsa
cucaguguccccugaacucuuuauuugccuaauuuauauauauauauaugagauauauaaauau

SEQ ID NO: 757177 - RNA, 64 nt, hsa
caguguccccugaacucuuuauuugccuaauuuauauauauauauaugagauauauaaauauau

SEQ ID NO: 757178 - RNA, 64 nt, hsa
guguccccugaacucuuuauuugccuaauuuauauauauauauaugagauauauaaauauauau

SEQ ID NO: 757179 - RNA, 64 nt, hsa
guccccugaacucuuuauuugccuaauuuauauauauauauaugagauauauaaauauauauaa

SEQ ID NO: 757180 - RNA, 64 nt, hsa
ccuaauuuauauauauauauaugagauauauaaauauauauaaaauagcuauuuugcuuaaauu

SEQ ID NO: 757181 - RNA, 64 nt, hsa
gucuuucuuucuacuccaggacugguuuuguuuuuauauauauaaaaaaaaaaagugaaaacac

SEQ ID NO: 757182 - RNA, 64 nt, hsa
cuuucuuucuacuccaggacugguuuuguuuuuauauauauaaaaaaaaaaagugaaaacacca

SEQ ID NO: 757183 - RNA, 64 nt, hsa
uuuaaauuuuuauaucuauacauacauauauacauauauauauaauguacaauauauacauaga

SEQ ID NO: 757184 - RNA, 64 nt, hsa
uaaauuuuuauaucuauacauacauauauacauauauauauaauguacaauauauacauagacu

SEQ ID NO: 757185 - RNA, 64 nt, hsa
ucucuuagauuuuaauuuauccuguaaauuucuguauauauaauuuaauaacagaagccuccac

SEQ ID NO: 757186 - RNA, 64 nt, hsa
cucccgcagcguuacugccuguguauaguauaaauauauauauuuucuauauauaagauguaua

SEQ ID NO: 757187 - RNA, 64 nt, hsa
acugccuguguauaguauaaauauauauauuuucuauauauaagauguauaauauaaggcucca

SEQ ID NO: 757188 - RNA, 64 nt, hsa
gcccaugguggcccuuccagugcauauacauacauauauauauauauaugcauauauauauaua

SEQ ID NO: 757189 - RNA, 64 nt, hsa
ccaugguggcccuuccagugcauauacauacauauauauauauauaugcauauauauauauaua

SEQ ID NO: 757190 - RNA, 64 nt, hsa
augguggcccuuccagugcauauacauacauauauauauauauaugcauauauauauauauaua

SEQ ID NO: 757191 - RNA, 64 nt, hsa
gguggcccuuccagugcauauacauacauauauauauauauaugcauauauauauauauauaua

SEQ ID NO: 757192 - RNA, 64 nt, hsa
agugcauauacauacauauauauauauauaugcauauauauauauauauauauauauaugugua

SEQ ID NO: 757193 - RNA, 64 nt, hsa
ugcauauacauacauauauauauauauaugcauauauauauauauauauauauauauguguaua

SEQ ID NO: 757194 - RNA, 64 nt, hsa
cauauacauacauauauauauauauaugcauauauauauauauauauauauauauguguauaca

SEQ ID NO: 757195 - RNA, 64 nt, hsa
uauacauacauauauauauauauaugcauauauauauauauauauauauauauguguauacaca

SEQ ID NO: 757196 - RNA, 64 nt, hsa
uacauacauauauauauauauaugcauauauauauauauauauauauauauguguauacacaca

SEQ ID NO: 757197 - RNA, 64 nt, hsa
cauacauauauauauauauaugcauauauauauauauauauauauauauguguauacacacaca

SEQ ID NO: 757198 - RNA, 64 nt, hsa
uacauauauauauauauaugcauauauauauauauauauauauauauguguauacacacacaca

SEQ ID NO: 757199 - RNA, 64 nt, hsa
cauauauauauauauaugcauauauauauauauauauauauauauguguauacacacacacaua

SEQ ID NO: 757200 - RNA, 64 nt, hsa
uauauauauauauaugcauauauauauauauauauauauauauguguauacacacacacauaga

SEQ ID NO: 757201 - RNA, 64 nt, hsa
uauauauguguauacacacacacauagacagacauauauauauauauuuauuuuuuuuacugag

SEQ ID NO: 757202 - RNA, 64 nt, hsa
uauauguguauacacacacacauagacagacauauauauauauauuuauuuuuuuuacugagag

SEQ ID NO: 757203 - RNA, 64 nt, hsa
uauguguauacacacacacauagacagacauauauauauauauuuauuuuuuuuacugagagcu

SEQ ID NO: 757204 - RNA, 64 nt, hsa
caaaagggguuaauguuacuuuaaaauuacauucuauauauauauaaauauauauaaauauaua

SEQ ID NO: 757205 - RNA, 64 nt, hsa
aaagggguuaauguuacuuuaaaauuacauucuauauauauauaaauauauauaaauauauauu

SEQ ID NO: 757206 - RNA, 64 nt, hsa
agggguuaauguuacuuuaaaauuacauucuauauauauauaaauauauauaaauauauauuaa

SEQ ID NO: 757207 - RNA, 64 nt, hsa
guuacuuuaaaauuacauucuauauauauauaaauauauauaaauauauauuaaaauaccaguu

SEQ ID NO: 757208 - RNA, 64 nt, hsa
gagaaaaaggaaagaugaaauaaauaaauaaacauauauauauagauauacacacacacauauc

SEQ ID NO: 757209 - RNA, 64 nt, hsa
gaaaaaggaaagaugaaauaaauaaauaaacauauauauauagauauacacacacacauaucug

SEQ ID NO: 757210 - RNA, 64 nt, hsa
aacauuuuguaaaaaaaaaaaaaauauauauauauauauauagcugacuggaagagauuaauuu

SEQ ID NO: 757211 - RNA, 64 nt, hsa
auaacauuuuguaaaaaaaaaaaaaauauauauauauauauauagcugacuggaagagauuaau

SEQ ID NO: 757212 - RNA, 64 nt, hsa
gaauaacauuuuguaaaaaaaaaaaaaauauauauauauauauauagcugacuggaagagauua

SEQ ID NO: 757213 - RNA, 64 nt, hsa
uggaauaacauuuuguaaaaaaaaaaaaaauauauauauauauauauagcugacuggaagagau

SEQ ID NO: 757214 - RNA, 64 nt, hsa
ucuggaauaacauuuuguaaaaaaaaaaaaaauauauauauauauauauagcugacuggaagag

SEQ ID NO: 757215 - RNA, 64 nt, hsa
agucuggaauaacauuuuguaaaaaaaaaaaaaauauauauauauauauauagcugacuggaag

SEQ ID NO: 757216 - RNA, 64 nt, hsa
auauaccuauugaaauucucucacucuguguauguauauauaccuauggaaaacuaguuguugg

SEQ ID NO: 757217 - RNA, 64 nt, hsa
uguuuguguguguauaccugacauauauaguagauauauauaccuauugaaauucucucacucu

SEQ ID NO: 757218 - RNA, 64 nt, hsa
ggguggggggaauuaaaagggagggauaaauauauauauauaaaucuauuuuuagucuggaaag

SEQ ID NO: 757219 - RNA, 64 nt, hsa
aaggguggggggaauuaaaagggagggauaaauauauauauauaaaucuauuuuuagucuggaa

SEQ ID NO: 757220 - RNA, 64 nt, hsa
gaaaggguggggggaauuaaaagggagggauaaauauauauauauaaaucuauuuuuagucugg

SEQ ID NO: 757221 - RNA, 64 nt, hsa
augcccacuuuauuuuauauccaaguuagugcauuauauauauauuuuugcuuuggcuauauuu

SEQ ID NO: 757222 - RNA, 64 nt, hsa
gcccacuuuauuuuauauccaaguuagugcauuauauauauauuuuugcuuuggcuauauuuac

SEQ ID NO: 757223 - RNA, 64 nt, hsa
uuauuuccguuuuuuaaaugaguugauguacccuuauauauauauacauauauauauaaauaua

SEQ ID NO: 757224 - RNA, 64 nt, hsa
auuuccguuuuuuaaaugaguugauguacccuuauauauauauacauauauauauaaauauaaa

SEQ ID NO: 757225 - RNA, 64 nt, hsa
uuccguuuuuuaaaugaguugauguacccuuauauauauauacauauauauauaaauauaaaua

SEQ ID NO: 757226 - RNA, 64 nt, hsa
uaaaugaguugauguacccuuauauauauauacauauauauauaaauauaaauauauauaaaaa

SEQ ID NO: 757227 - RNA, 64 nt, hsa
aaugaguugauguacccuuauauauauauacauauauauauaaauauaaauauauauaaaaaca

SEQ ID NO: 757228 - RNA, 64 nt, hsa
cuuauauauauauacauauauauauaaauauaaauauauauaaaaacaacaaaacaaaacaaaa

SEQ ID NO: 757229 - RNA, 64 nt, hsa
agugcccaguuuuuguucauuuuugaaaucugauuauauauauuuuauauauacuuauguaugu

SEQ ID NO: 757230 - RNA, 64 nt, hsa
uuuguucauuuuugaaaucugauuauauauauuuuauauauacuuauguauguauauauaauau

SEQ ID NO: 757231 - RNA, 64 nt, hsa
cugauuauauauauuuuauauauacuuauguauguauauauaauauauauagaaaucuggauau

SEQ ID NO: 757232 - RNA, 64 nt, hsa
uauauuuuauauauacuuauguauguauauauaauauauauagaaaucuggauauauauguaua

SEQ ID NO: 757233 - RNA, 64 nt, hsa
auuuuauuuguaccuguaaauacuguacagcuaauauauauauauauauauauauaugugugug

SEQ ID NO: 757234 - RNA, 64 nt, hsa
uuuauuuguaccuguaaauacuguacagcuaauauauauauauauauauauauaugugugugug

SEQ ID NO: 757235 - RNA, 64 nt, hsa
uauuuguaccuguaaauacuguacagcuaauauauauauauauauauauauaugugugugugug

SEQ ID NO: 757236 - RNA, 64 nt, hsa
uuuguaccuguaaauacuguacagcuaauauauauauauauauauauauaugugugugugugug

SEQ ID NO: 757237 - RNA, 64 nt, hsa
uguaccuguaaauacuguacagcuaauauauauauauauauauauauaugugugugugugugug

SEQ ID NO: 757238 - RNA, 64 nt, hsa
uaccuguaaauacuguacagcuaauauauauauauauauauauauaugugugugugugugugug

SEQ ID NO: 757239 - RNA, 64 nt, hsa
ccuguaaauacuguacagcuaauauauauauauauauauauauaugugugugugugugugugug

SEQ ID NO: 757240 - RNA, 64 nt, hsa
uguaaauacuguacagcuaauauauauauauauauauauauaugugugugugugugugugugua

SEQ ID NO: 757241 - RNA, 64 nt, hsa
uguuuauagagauacacacacauauauauguguguauauauauacacauacauauauauacaca

SEQ ID NO: 757242 - RNA, 64 nt, hsa
uuuauagagauacacacacauauauauguguguauauauauacacauacauauauauacacaca

SEQ ID NO: 757243 - RNA, 64 nt, hsa
cacauauauauguguguauauauauacacauacauauauauacacacacgcauuugcacagaca

SEQ ID NO: 757244 - RNA, 64 nt, hsa
guauuuuuugaauugaguauaaucacuuugcuaguauauauaauuuaauagauuuuauuuaucu

SEQ ID NO: 757245 - RNA, 64 nt, hsa
uuuauaaauguguauuucuguguauucacauacauauauauauacacacauauauauguacaua

SEQ ID NO: 757246 - RNA, 64 nt, hsa
uauaaauguguauuucuguguauucacauacauauauauauacacacauauauauguacauaca

SEQ ID NO: 757247 - RNA, 64 nt, hsa
uaaauaagccacccuucugauugucguucuacuguauauauauauauauuugaguguuguuugu

SEQ ID NO: 757248 - RNA, 64 nt, hsa
aauaagccacccuucugauugucguucuacuguauauauauauauauuugaguguuguuugugu

SEQ ID NO: 757249 - RNA, 64 nt, hsa
uaagccacccuucugauugucguucuacuguauauauauauauauuugaguguuguuuguguuu

SEQ ID NO: 757250 - RNA, 64 nt, hsa
agccacccuucugauugucguucuacuguauauauauauauauuugaguguuguuuguguuuca

SEQ ID NO: 757251 - RNA, 64 nt, hsa
uuuugaagaauuccuuuuguguuuuaaaaugugauauauauauauauaaaauuccuaggaugca

SEQ ID NO: 757252 - RNA, 64 nt, hsa
uugaagaauuccuuuuguguuuuaaaaugugauauauauauauauaaaauuccuaggaugcagu

SEQ ID NO: 757253 - RNA, 64 nt, hsa
gaagaauuccuuuuguguuuuaaaaugugauauauauauauauaaaauuccuaggaugcagugu

SEQ ID NO: 757254 - RNA, 64 nt, hsa
agaauuccuuuuguguuuuaaaaugugauauauauauauauaaaauuccuaggaugcagugucu

SEQ ID NO: 757255 - RNA, 64 nt, hsa
gugugggaauagggaucuaaauuuuaaauaaaauuauauauauauauaaauuggugcugauuuu

SEQ ID NO: 757256 - RNA, 64 nt, hsa
gugggaauagggaucuaaauuuuaaauaaaauuauauauauauauaaauuggugcugauuuuau

SEQ ID NO: 757257 - RNA, 64 nt, hsa
gggaauagggaucuaaauuuuaaauaaaauuauauauauauauaaauuggugcugauuuuauaa

SEQ ID NO: 757258 - RNA, 64 nt, hsa
gaauagggaucuaaauuuuaaauaaaauuauauauauauauaaauuggugcugauuuuauaauu

SEQ ID NO: 757259 - RNA, 64 nt, hsa
ggggaaaaguuucuuucagagaguuaaguuauuuuauauauauaauauauauauaaaauauaua

SEQ ID NO: 757260 - RNA, 64 nt, hsa
ggaaaaguuucuuucagagaguuaaguuauuuuauauauauaauauauauauaaaauauauaau

SEQ ID NO: 757261 - RNA, 64 nt, hsa
ucuuucagagaguuaaguuauuuuauauauauaauauauauauaaaauauauaauauacaauau

SEQ ID NO: 757262 - RNA, 64 nt, hsa
uuucagagaguuaaguuauuuuauauauauaauauauauauaaaauauauaauauacaauauaa

SEQ ID NO: 757263 - RNA, 64 nt, hsa
ucuuccuggaacucacuuuuuauauaauguuuuauauauauauuuuuuccuuucaaaucagacg

SEQ ID NO: 757264 - RNA, 64 nt, hsa
uuucuuccuggaacucacuuuuuauauaauguuuuauauauauauuuuuuccuuucaaaucaga

SEQ ID NO: 757265 - RNA, 64 nt, hsa
ccaauaaggauuuagaaccagagugacugauauauauauauauuuuaauucagaguuacauaca

SEQ ID NO: 757266 - RNA, 64 nt, hsa
gcccaauaaggauuuagaaccagagugacugauauauauauauauuuuaauucagaguuacaua

SEQ ID NO: 757267 - RNA, 64 nt, hsa
uugcccaauaaggauuuagaaccagagugacugauauauauauauauuuuaauucagaguuaca

SEQ ID NO: 757268 - RNA, 64 nt, hsa
uuuucauugugcucuguacguauauaaauauauauauauauacacacacacacacacauuaguc

SEQ ID NO: 757269 - RNA, 64 nt, hsa
gcuuuucauugugcucuguacguauauaaauauauauauauauacacacacacacacacauuag

SEQ ID NO: 757270 - RNA, 64 nt, hsa
gugcuuuucauugugcucuguacguauauaaauauauauauauauacacacacacacacacauu

SEQ ID NO: 757271 - RNA, 64 nt, hsa
uugugcuuuucauugugcucuguacguauauaaauauauauauauauacacacacacacacaca

SEQ ID NO: 757272 - RNA, 64 nt, hsa
ucuguacauaaaaguguuuuugcuaaauuuacaguauauauagauccuuucauauuauuuuacu

SEQ ID NO: 757273 - RNA, 64 nt, hsa
uacaauuuugagugcuuuauaaacacuuaagauauauauauaaauuuuaauuucauagcaacuu

SEQ ID NO: 757274 - RNA, 64 nt, hsa
gcuacaauuuugagugcuuuauaaacacuuaagauauauauauaaauuuuaauuucauagcaac

SEQ ID NO: 757275 - RNA, 64 nt, hsa
agacccugucuuugcuguuuauauauauauauauuauauauaaauaucuauuuaucugucugag

SEQ ID NO: 757276 - RNA, 64 nt, hsa
caagccaggagacccugucuuugcuguuuauauauauauauauuauauauaaauaucuauuuau

SEQ ID NO: 757277 - RNA, 64 nt, hsa
cucaagccaggagacccugucuuugcuguuuauauauauauauauuauauauaaauaucuauuu

SEQ ID NO: 757278 - RNA, 64 nt, hsa
cccucaagccaggagacccugucuuugcuguuuauauauauauauauuauauauaaauaucuau

SEQ ID NO: 757279 - RNA, 64 nt, hsa
accccucaagccaggagacccugucuuugcuguuuauauauauauauauuauauauaaauaucu

SEQ ID NO: 757280 - RNA, 64 nt, hsa
cuugaaaccuuuggauaggggaaaaaauuauauauauauauauuuuuuuguucuguuugcauuu

SEQ ID NO: 757281 - RNA, 64 nt, hsa
gacuugaaaccuuuggauaggggaaaaaauuauauauauauauauuuuuuuguucuguuugcau

SEQ ID NO: 757282 - RNA, 64 nt, hsa
gagacuugaaaccuuuggauaggggaaaaaauuauauauauauauauuuuuuuguucuguuugc

SEQ ID NO: 757283 - RNA, 64 nt, hsa
uugagacuugaaaccuuuggauaggggaaaaaauuauauauauauauauuuuuuuguucuguuu

SEQ ID NO: 757284 - RNA, 64 nt, hsa
cguauacauauauacaacuauauauacacaaauauauauauacacaaaacugucauuuaccugu

SEQ ID NO: 757285 - RNA, 64 nt, hsa
gccguauacauauauacaacuauauauacacaaauauauauauacacaaaacugucauuuaccu

SEQ ID NO: 757286 - RNA, 64 nt, hsa
ccuuugugucuacugccguauacauauauacaacuauauauacacaaauauauauauacacaaa

SEQ ID NO: 757287 - RNA, 64 nt, hsa
gcacuuuuucuuaaucauuuuuuauauauaugcauauauauauguguguguguguguugcuuau

SEQ ID NO: 757288 - RNA, 64 nt, hsa
cuguuauucuuugcacuuuuucuuaaucauuuuuuauauauaugcauauauauaugugugugug

SEQ ID NO: 757289 - RNA, 64 nt, hsa
auugaauggaucaauacacacacacagacauauauauauauaugcacacauauauaggcaguug

SEQ ID NO: 757290 - RNA, 64 nt, hsa
acauugaauggaucaauacacacacacagacauauauauauauaugcacacauauauaggcagu

SEQ ID NO: 757291 - RNA, 64 nt, hsa
ugacauugaauggaucaauacacacacacagacauauauauauauaugcacacauauauaggca

SEQ ID NO: 757292 - RNA, 64 nt, hsa
ugggaccaaaaaaugcacuuguuucuugcucauauauauauagauguauauuuuuuuuaauuuc

SEQ ID NO: 757293 - RNA, 64 nt, hsa
auugggaccaaaaaaugcacuuguuucuugcucauauauauauagauguauauuuuuuuuaauu

SEQ ID NO: 757294 - RNA, 64 nt, hsa
uuacaaaguauuuuguugcacauucagagaauuuuauauauauaugucuuguguggguguccuc

SEQ ID NO: 757295 - RNA, 64 nt, hsa
acaaaguauuuuguugcacauucagagaauuuuauauauauaugucuuguguggguguccucga

SEQ ID NO: 757296 - RNA, 64 nt, hsa
ccuccucuucuagaauugcuuugcucuauuuuuguauauauaaauauguuaugaugauuauuaa

SEQ ID NO: 757297 - RNA, 64 nt, hsa
gugagugagugugcguauguaucccuucugugauuauauauauucacacaucucuauauauuuu

SEQ ID NO: 757298 - RNA, 64 nt, hsa; identical to SEQ ID NO: 283920

SEQ ID NO: 757299 - RNA, 64 nt, hsa; identical to SEQ ID NO: 283921

SEQ ID NO: 757300 - RNA, 64 nt, hsa; identical to SEQ ID NO: 283922

SEQ ID NO: 757301 - RNA, 64 nt, hsa; identical to SEQ ID NO: 283923

SEQ ID NO: 757302 - RNA, 64 nt, hsa; identical to SEQ ID NO: 283924

SEQ ID NO: 757303 - RNA, 64 nt, hsa; identical to SEQ ID NO: 283925

SEQ ID NO: 757304 - RNA, 64 nt, hsa; identical to SEQ ID NO: 283926

SEQ ID NO: 757305 - RNA, 64 nt, hsa; identical to SEQ ID NO: 283927

SEQ ID NO: 757306 - RNA, 64 nt, hsa; identical to SEQ ID NO: 283928

SEQ ID NO: 757307 - RNA, 64 nt, hsa; identical to SEQ ID NO: 283929

SEQ ID NO: 757308 - RNA, 64 nt, hsa; identical to SEQ ID NO: 283930

SEQ ID NO: 757309 - RNA, 64 nt, hsa; identical to SEQ ID NO: 283931

SEQ ID NO: 757310 - RNA, 64 nt, hsa; identical to SEQ ID NO: 283932

SEQ ID NO: 757311 - RNA, 64 nt, hsa; identical to SEQ ID NO: 283933

SEQ ID NO: 757312 - RNA, 64 nt, hsa; identical to SEQ ID NO: 283934

SEQ ID NO: 757313 - RNA, 64 nt, hsa; identical to SEQ ID NO: 283935

SEQ ID NO: 757314 - RNA, 64 nt, hsa; identical to SEQ ID NO: 283930

SEQ ID NO: 757315 - RNA, 64 nt, hsa; identical to SEQ ID NO: 283937

SEQ ID NO: 757316 - RNA, 64 nt, hsa; identical to SEQ ID NO: 283938

SEQ ID NO: 757317 - RNA, 64 nt, hsa; identical to SEQ ID NO: 283939

SEQ ID NO: 757318 - RNA, 64 nt, hsa; identical to SEQ ID NO: 283940

SEQ ID NO: 757319 - RNA, 64 nt, hsa; identical to SEQ ID NO: 283941

SEQ ID NO: 757320 - RNA, 64 nt, hsa; identical to SEQ ID NO: 283942

SEQ ID NO: 757321 - RNA, 64 nt, hsa; identical to SEQ ID NO: 283943

SEQ ID NO: 757322 - RNA, 64 nt, hsa; identical to SEQ ID NO: 283944

SEQ ID NO: 757323 - RNA, 60 nt, hsa; identical to SEQ ID NO: 283945

SEQ ID NO: 757324 - RNA, 64 nt, hsa; identical to SEQ ID NO: 283946

SEQ ID NO: 757325 - RNA, 64 nt, hsa; identical to SEQ ID NO: 283947

SEQ ID NO: 757326 - RNA, 64 nt, hsa; identical to SEQ ID NO: 283948

SEQ ID NO: 757327 - RNA, 64 nt, hsa; identical to SEQ ID NO: 283949

SEQ ID NO: 757328 - RNA, 64 nt, hsa; identical to SEQ ID NO: 283950

SEQ ID NO: 757329 - RNA, 64 nt, hsa; identical to SEQ ID NO: 283951

SEQ ID NO: 757330 - RNA, 64 nt, hsa; identical to SEQ ID NO: 283952

SEQ ID NO: 757331 - RNA, 64 nt, hsa; identical to SEQ ID NO: 283953

SEQ ID NO: 757332 - RNA, 64 nt, hsa; identical to SEQ ID NO: 283954

SEQ ID NO: 757333 - RNA, 64 nt, hsa; identical to SEQ ID NO: 283955

SEQ ID NO: 757334 - RNA, 64 nt, hsa; identical to SEQ ID NO: 283956

SEQ ID NO: 757335 - RNA, 64 nt, hsa; identical to SEQ ID NO: 283957

SEQ ID NO: 757336 - RNA, 64 nt, hsa; identical to SEQ ID NO: 283958

SEQ ID NO: 757337 - RNA, 64 nt, hsa; identical to SEQ ID NO: 283959

SEQ ID NO: 757338 - RNA, 64 nt, hsa; identical to SEQ ID NO: 283960

SEQ ID NO: 757339 - RNA, 64 nt, hsa; identical to SEQ ID NO: 283961

SEQ ID NO: 757340 - RNA, 64 nt, hsa; identical to SEQ ID NO: 283962

SEQ ID NO: 757341 - RNA, 64 nt, hsa; identical to SEQ ID NO: 283963

SEQ ID NO: 757342 - RNA, 64 nt, hsa; identical to SEQ ID NO: 283964

SEQ ID NO: 757343 - RNA, 64 nt, hsa; identical to SEQ ID NO: 283965

SEQ ID NO: 757344 - RNA, 64 nt, hsa; identical to SEQ ID NO: 283966

SEQ ID NO: 757345 - RNA, 64 nt, hsa; identical to SEQ ID NO: 283967

SEQ ID NO: 757346 - RNA, 64 nt, hsa; identical to SEQ ID NO: 283968

SEQ ID NO: 757347 - RNA, 64 nt, hsa; identical to SEQ ID NO: 283969

SEQ ID NO: 757348 - RNA, 64 nt, hsa; identical to SEQ ID NO: 283970

SEQ ID NO: 757349 - RNA, 64 nt, hsa; identical to SEQ ID NO: 283971

SEQ ID NO: 757350 - RNA, 64 nt, hsa; identical to SEQ ID NO: 283972

SEQ ID NO: 757351 - RNA, 64 nt, hsa; identical to SEQ ID NO: 283973

SEQ ID NO: 757352 - RNA, 64 nt, hsa; identical to SEQ ID NO: 283974

SEQ ID NO: 757353 - RNA, 64 nt, hsa; identical to SEQ ID NO: 283975

SEQ ID NO: 757354 - RNA, 64 nt, hsa; identical to SEQ ID NO: 283976

SEQ ID NO: 757355 - RNA, 64 nt, hsa; identical to SEQ ID NO: 283977

SEQ ID NO: 757356 - RNA, 64 nt, hsa; identical to SEQ ID NO: 283978

SEQ ID NO: 757357 - RNA, 64 nt, hsa; identical to SEQ ID NO: 283979

SEQ ID NO: 757358 - RNA, 64 nt, hsa; identical to SEQ ID NO: 283980

SEQ ID NO: 757359 - RNA, 64 nt, hsa; identical to SEQ ID NO: 283981

SEQ ID NO: 757360 - RNA, 64 nt, hsa; identical to SEQ ID NO: 283982

SEQ ID NO: 757361 - RNA, 64 nt, hsa; identical to SEQ ID NO: 283983

SEQ ID NO: 757362 - RNA, 64 nt, hsa; identical to SEQ ID NO: 283984

SEQ ID NO: 757363 - RNA, 64 nt, hsa; identical to SEQ ID NO: 114926

SEQ ID NO: 757364 - RNA, 64 nt, hsa; identical to SEQ ID NO: 114927

SEQ ID NO: 757365 - RNA, 64 nt, hsa
caccuccaguuuggcuucugagcagagacucccugcccaucaagucugaaacccccauggauga

SEQ ID NO: 757366 - RNA, 64 nt, hsa
gacuccgacugaggcaugcccugccccaccacucgcccaucaggccuguccugcagaggauggu

SEQ ID NO: 757367 - RNA, 64 nt, hsa
uugcugucuacagccaacuauucuauuaguuacaaaacucaaucauuuuauucagcaacuggau

SEQ ID NO: 757368 - RNA, 64 nt, hsa
caucaaaaaaauaaaguaaaauagaaaacugagaaaacucaauccaugaccagggagaacuuac

SEQ ID NO: 757369 - RNA, 64 nt, hsa
gaagaauggugccaccacucaagcaacaagccucaaacucaaccaugucaucuuuuucuuggau

SEQ ID NO: 757370 - RNA, 64 nt, hsa
cauaaaggacaagaugguuaagucaauucuguuaaaacucaaggcuuauauuaagcaaacacuu

SEQ ID NO: 757371 - RNA, 64 nt, hsa
uuuucugcacaaagaauaaaauuaaggauuuuauaaacucaaauuggcaccuacugaauuaaaa

SEQ ID NO: 757372 - RNA, 64 nt, hsa
cuggcuuugauuaaaggccauuuuuaaaacuuaaaaacucaacaccucacagauuauaauagaa

SEQ ID NO: 757373 - RNA, 64 nt, hsa
aguuucucuguuugcuugucauagcagcauuuggaaacucaaacaugcuuucauuuacauaaau

SEQ ID NO: 757374 - RNA, 64 nt, hsa
uaaggguauuaauuauugaaagucccuuuccccaaaacucaacuccuauggcaauuaugaacuc

SEQ ID NO: 757375 - RNA, 64 nt, hsa
aagugucuuuucagccuuuccaucuuuacaaauaaaacucaaaaaagccguccagcuuauccca

SEQ ID NO: 757376 - RNA, 64 nt, hsa
ccuaaggauugccugugugcuggaaauauauuugaaacucaaccaguaugcccagccuauugca

SEQ ID NO: 757377 - RNA, 64 nt, hsa
aaaagccagacaaacccaaguuguccaggcaaauaaacucaaaucuuugucacgucugauauua

SEQ ID NO: 757378 - RNA, 64 nt, hsa
auauuggugcacuuuaauacuaucacaucuuugaaaacucaauuugaguuuuaccaauuaaugu

SEQ ID NO: 757379 - RNA, 64 nt, hsa
cuuuaaaaaucuuucccagaaguugguuccuagaaaacucaauaccaucaucucuuaucucuau

SEQ ID NO: 757380 - RNA, 64 nt, hsa
aaccaucuguuacuguucuaaaaauguuuaaaagaaacucaauacagauaaagauaaauaugug

SEQ ID NO: 757381 - RNA, 64 nt, hsa
agcuuuggcaugacuguuugucucgaaaaccaauaaacucaaaguuuagaaaaacucauucaug

SEQ ID NO: 757382 - RNA, 60 nt, hsa; identical to SEQ ID NO: 93955

SEQ ID NO: 757383 - RNA, 64 nt, hsa
aggacuauuucucuaaaacucaaaaaaaaaaaaaaaacucaagauaguaaaagcaccuagugug

SEQ ID NO: 757384 - RNA, 64 nt, hsa
guuucuaagucauauuaaaaggacuauuucucuaaaacucaaaaaaaaaaaaaaaacucaagau

SEQ ID NO: 757385 - RNA, 64 nt, hsa
uuaagacuagaaccuauaggaaacuacuuggagcaaacucaaaggacagauuagggaucgagau

SEQ ID NO: 757386 - RNA, 64 nt, hsa
gcagaaagcgugauagaggagagaauuuuugacaaaacucaaaaguuguuugcacagcuguucu

SEQ ID NO: 757387 - RNA, 64 nt, hsa
cauguagauguuuuguguguauuuuuuuaaaugaaaacucaaaauaagacaaguaauuuguuga

SEQ ID NO: 757388 - RNA, 64 nt, hsa
acccagcaagcuacaaagagggugugucacacugaaacucaauaguugaguuuggcuguuguug

SEQ ID NO: 757389 - RNA, 64 nt, hsa
uugucaguauggcuuuuaguacugaagccaaaugaaacucaaaaccaucucucuuccagcugcu

SEQ ID NO: 757390 - RNA, 64 nt, hsa
uugugaaucaccaaaggagcuauggagagaauuaaaacucaacauuacuguuaacugugcguua

SEQ ID NO: 757391 - RNA, 64 nt, hsa
cucaaacucaguccaucugaugccaguguugaguaaacucaacuacuaugaaauuucaccuaau

SEQ ID NO: 757392 - RNA, 62 nt, hsa
caccuggagguggccauuaauuggcaccacucaaacucaaacucaguccaucugaugccagu

SEQ ID NO: 757393 - RNA, 64 nt, hsa
uauauguaaucccaacaucuaauuuuagucuuagaaacucaaacuauuaauaaguggaaaaagu

SEQ ID NO: 757394 - RNA, 64 nt, hsa
ugcucacuuguugcaguacaaucaucggguuaaaaaacucaaugaaaucagcaaacugggaauu

SEQ ID NO: 757395 - RNA, 64 nt, hsa
aagcuucaaugucuuuuuuuuuuuuuucauggaaaaacucaaaccucuguuauuugggagcuca

SEQ ID NO: 757396 - RNA, 64 nt, hsa
aguuuugcuugacaguuucuaaacaaacaaaaauaaacucaaugaaaggaaagauguuucuuuu

SEQ ID NO: 757397 - RNA, 64 nt, hsa
ggaaaauaucuuggggccccagaaucacuaaggaaaacucaagcuuagggaaacuucuuagggc

SEQ ID NO: 757398 - RNA, 64 nt, hsa
auaucugauugccuccuuuggaaaggcuaaucagaaacucaaaagaaugcaacuguuugugucu

SEQ ID NO: 757399 - RNA, 64 nt, hsa
aucugaucaauuuggaauauauaaaguguacuaaaaacucaacugaagucaggcaugguagcuc

SEQ ID NO: 757400 - RNA, 64 nt, hsa
ugaggccucaucucaaaaaaaaaaaaaggccacaaaacucaacaauaaaaacaaacaguccaau

SEQ ID NO: 757401 - RNA, 64 nt, hsa
uauuuugcuuaagucaacagugcccuaaaacuccaaacucaaaugcagucaauuauucacgcca

SEQ ID NO: 757402 - RNA, 64 nt, hsa
caagacagacaguauuggauaggguaaagcaagaaaacucaagcugcagcuggacugcaggcuu

SEQ ID NO: 757403 - RNA, 64 nt, hsa; identical to SEQ ID NO: 94908

SEQ ID NO: 757404 - RNA, 64 nt, hsa; identical to SEQ ID NO: 94909

SEQ ID NO: 757405 - RNA, 64 nt, hsa; identical to SEQ ID NO: 94910

SEQ ID NO: 757406 - RNA, 64 nt, hsa; identical to SEQ ID NO: 94911

SEQ ID NO: 757407 - RNA, 64 nt, hsa; identical to SEQ ID NO: 94912

SEQ ID NO: 757408 - RNA, 64 nt, hsa; identical to SEQ ID NO: 94913

SEQ ID NO: 757409 - RNA, 64 nt, hsa; identical to SEQ ID NO: 94914

SEQ ID NO: 757410 - RNA, 64 nt, hsa; identical to SEQ ID NO: 94915

SEQ ID NO: 757411 - RNA, 64 nt, hsa; identical to SEQ ID NO: 94916

SEQ ID NO: 757412 - RNA, 64 nt, hsa; identical to SEQ ID NO: 94917

SEQ ID NO: 757413 - RNA, 64 nt, hsa; identical to SEQ ID NO: 94918

SEQ ID NO: 757414 - RNA, 64 nt, hsa; identical to SEQ ID NO: 94919

SEQ ID NO: 757415 - RNA, 64 nt, hsa; identical to SEQ ID NO: 94920

SEQ ID NO: 757416 - RNA, 64 nt, hsa; identical to SEQ ID NO: 94921

SEQ ID NO: 757417 - RNA, 64 nt, hsa; identical to SEQ ID NO: 94922

SEQ ID NO: 757418 - RNA, 64 nt, hsa; identical to SEQ ID NO: 94923

SEQ ID NO: 757419 - RNA, 64 nt, hsa; identical to SEQ ID NO: 94924

SEQ ID NO: 757420 - RNA, 64 nt, hsa; identical to SEQ ID NO: 94925

SEQ ID NO: 757421 - RNA, 64 nt, hsa; identical to SEQ ID NO: 94926

SEQ ID NO: 757422 - RNA, 64 nt, hsa; identical to SEQ ID NO: 94927

SEQ ID NO: 757423 - RNA, 64 nt, hsa; identical to SEQ ID NO: 94928

SEQ ID NO: 757424 - RNA, 64 nt, hsa; identical to SEQ ID NO: 94929

SEQ ID NO: 757425 - RNA, 64 nt, hsa; identical to SEQ ID NO: 94930

SEQ ID NO: 757426 - RNA, 64 nt, hsa; identical to SEQ ID NO: 94931

SEQ ID NO: 757427 - RNA, 64 nt, hsa; identical to SEQ ID NO: 263107

SEQ ID NO: 757428 - RNA, 64 nt, hsa; identical to SEQ ID NO: 263108

SEQ ID NO: 757429 - RNA, 64 nt, hsa; identical to SEQ ID NO: 263109

SEQ ID NO: 757430 - RNA, 64 nt, hsa; identical to SEQ ID NO: 263110

SEQ ID NO: 757431 - RNA, 64 nt, hsa; identical to SEQ ID NO: 263111

SEQ ID NO: 757432 - RNA, 64 nt, hsa; identical to SEQ ID NO: 263112

SEQ ID NO: 757433 - RNA, 64 nt, hsa; identical to SEQ ID NO: 263113

SEQ ID NO: 757434 - RNA, 64 nt, hsa; identical to SEQ ID NO: 263114

SEQ ID NO: 757435 - RNA, 64 nt, hsa; identical to SEQ ID NO: 263115

SEQ ID NO: 757436 - RNA, 64 nt, hsa; identical to SEQ ID NO: 263116

SEQ ID NO: 757437 - RNA, 64 nt, hsa; identical to SEQ ID NO: 263117

SEQ ID NO: 757438 - RNA, 64 nt, hsa; identical to SEQ ID NO: 263118

SEQ ID NO: 757439 - RNA, 64 nt, hsa; identical to SEQ ID NO: 263119

SEQ ID NO: 757440 - RNA, 64 nt, hsa; identical to SEQ ID NO: 263120

SEQ ID NO: 757441 - RNA, 64 nt, hsa; identical to SEQ ID NO: 494502

SEQ ID NO: 757442 - RNA, 64 nt, hsa; identical to SEQ ID NO: 494503

SEQ ID NO: 757443 - RNA, 64 nt, hsa; identical to SEQ ID NO: 494504

SEQ ID NO: 757444 - RNA, 64 nt, hsa; identical to SEQ ID NO: 494505

SEQ ID NO: 757445 - RNA, 64 nt, hsa; identical to SEQ ID NO: 494506

SEQ ID NO: 757446 - RNA, 64 nt, hsa; identical to SEQ ID NO: 494507

SEQ ID NO: 757447 - RNA, 64 nt, hsa; identical to SEQ ID NO: 494508

SEQ ID NO: 757448 - RNA, 64 nt, hsa; identical to SEQ ID NO: 494509

SEQ ID NO: 757449 - RNA, 64 nt, hsa; identical to SEQ ID NO: 494510

SEQ ID NO: 757450 - RNA, 64 nt, hsa; identical to SEQ ID NO: 494511

SEQ ID NO: 757451 - RNA, 64 nt, hsa; identical to SEQ ID NO: 494512

SEQ ID NO: 757452 - RNA, 64 nt, hsa; identical to SEQ ID NO: 494513

SEQ ID NO: 757453 - RNA, 64 nt, hsa; identical to SEQ ID NO: 494514

SEQ ID NO: 757454 - RNA, 64 nt, hsa; identical to SEQ ID NO: 494515

SEQ ID NO: 757455 - RNA, 62 nt, hsa
gaacuuuccagcucccccucaucaugccuccuccuuccuaccugccuccccucugcuggugc

SEQ ID NO: 757456 - RNA, 62 nt, hsa
cucucaucuuacuuuuucuucucagauuucucccuuccuagaacauucucucuguuuagcac

SEQ ID NO: 757457 - RNA, 62 nt, hsa
uuguugcuguuggucauuuggccugccuuuucccuuccuauuucacuuugccucccaucaca

SEQ ID NO: 757458 - RNA, 62 nt, hsa
auaaagucaucuaacuauuaaaaaaaaaacacccuuccuaacccuucuuuucuuaaaauucc

SEQ ID NO: 757459 - RNA, 62 nt, hsa
cugcucugaugaaacccaauaaucucucaauaccuuccuauuucucaauagucuuuaaaccc

SEQ ID NO: 757460 - RNA, 62 nt, hsa
aguccgcucugaugaaacccagucucucaauaccuuccuauuucucaauagucuuuaagccc

SEQ ID NO: 757461 - RNA, 62 nt, hsa
ucuaaaauucagcuuuaaaaauauugaacauaccuuccuaccacuuacgcuucaaguuucau

SEQ ID NO: 757462 - RNA, 62 nt, hsa
ugugugugcucuauugaugcaagacaagucauccuuccuacugucaugguuuguuauagaga

SEQ ID NO: 757463 - RNA, 62 nt, hsa
cucccuuuccuuccuaauuucccuucuugcauccuuccuauaacuugaugcaugugguuugg

SEQ ID NO: 757464 - RNA, 62 nt, hsa; identical to SEQ ID NO: 77867

SEQ ID NO: 757465 - RNA, 62 nt, hsa
ucuuugauuuuucuuuagcuucaucaguccuuccuuccuaaucucuaauccccugaagccua

SEQ ID NO: 757466 - RNA, 62 nt, hsa
uacuuagucuguguccaugugauccaaaauuaccuuccuauugcauuuccuacuccuuugcu

SEQ ID NO: 757467 - RNA, 62 nt, hsa
uuacucgcuuuguuuaauggauuccaccccugccuuccuaggugaccuuggacaaauucucg

SEQ ID NO: 757468 - RNA, 62 nt, hsa
auauguccucaaaauccccauaaauauccaucccuuccuagauggcauuaacuuucauuuua

SEQ ID NO: 757469 - RNA, 62 nt, hsa
cccucugggcuccuuugguaacagauggagcuccuuccuagcuagggagaccuuaugagaag

SEQ ID NO: 757470 - RNA, 62 nt, hsa
uccuacuuuccuucauucucucuuccuucccuccuuccuacuucuuuucuuccuuccucuuc

SEQ ID NO: 757471 - RNA, 62 nt, hsa
uugucucuucagaguaaaugguucccuucuuuccuuccuacuuuccuucauucucucuuccu

SEQ ID NO: 757472 - RNA, 62 nt, hsa
guagauugagccauacucuggcugccucuuugccuuccuaggggcauuuucuuuaacuucca

SEQ ID NO: 757473 - RNA, 62 nt, hsa
ggguaccuuguuccaggcagucaguccauuugccuuccuaguacuuagcccccucugacaau

SEQ ID NO: 757474 - RNA, 64 nt, hsa; identical to SEQ ID NO: 494502

SEQ ID NO: 757475 - RNA, 64 nt, hsa; identical to SEQ ID NO: 494503

SEQ ID NO: 757476 - RNA, 64 nt, hsa; identical to SEQ ID NO: 494504

SEQ ID NO: 757477 - RNA, 64 nt, hsa; identical to SEQ ID NO: 494505

SEQ ID NO: 757478 - RNA, 64 nt, hsa; identical to SEQ ID NO: 494506

SEQ ID NO: 757479 - RNA, 64 nt, hsa; identical to SEQ ID NO: 494507

SEQ ID NO: 757480 - RNA, 64 nt, hsa; identical to SEQ ID NO: 494508

SEQ ID NO: 757481 - RNA, 64 nt, hsa; identical to SEQ ID NO: 494509

SEQ ID NO: 757482 - RNA, 64 nt, hsa; identical to SEQ ID NO: 494510

SEQ ID NO: 757483 - RNA, 64 nt, hsa; identical to SEQ ID NO: 494511

SEQ ID NO: 757484 - RNA, 64 nt, hsa; identical to SEQ ID NO: 494512

SEQ ID NO: 757485 - RNA, 64 nt, hsa; identical to SEQ ID NO: 494513

SEQ ID NO: 757486 - RNA, 64 nt, hsa; identical to SEQ ID NO: 494514

SEQ ID NO: 757487 - RNA, 64 nt, hsa; identical to SEQ ID NO: 494515

SEQ ID NO: 757488 - RNA, 62 nt, hsa; identical to SEQ ID NO: 757455

SEQ ID NO: 757489 - RNA, 62 nt, hsa; identical to SEQ ID NO: 757456

SEQ ID NO: 757490 - RNA, 62 nt, hsa; identical to SEQ ID NO: 757457

SEQ ID NO: 757491 - RNA, 62 nt, hsa; identical to SEQ ID NO: 757458

SEQ ID NO: 757492 - RNA, 62 nt, hsa; identical to SEQ ID NO: 757459

SEQ ID NO: 757493 - RNA, 62 nt, hsa; identical to SEQ ID NO: 757460

SEQ ID NO: 757494 - RNA, 62 nt, hsa; identical to SEQ ID NO: 757461

SEQ ID NO: 757495 - RNA, 62 nt, hsa; identical to SEQ ID NO: 757462

SEQ ID NO: 757496 - RNA, 62 nt, hsa; identical to SEQ ID NO: 757463

SEQ ID NO: 757497 - RNA, 62 nt, hsa; identical to SEQ ID NO: 77867

SEQ ID NO: 757498 - RNA, 62 nt, hsa; identical to SEQ ID NO: 757465

SEQ ID NO: 757499 - RNA, 62 nt, hsa; identical to SEQ ID NO: 757466

SEQ ID NO: 757500 - RNA, 62 nt, hsa; identical to SEQ ID NO: 757467

SEQ ID NO: 757501 - RNA, 62 nt, hsa; identical to SEQ ID NO: 757468

SEQ ID NO: 757502 - RNA, 62 nt, hsa; identical to SEQ ID NO: 757469

SEQ ID NO: 757503 - RNA, 62 nt, hsa; identical to SEQ ID NO: 757470

SEQ ID NO: 757504 - RNA, 62 nt, hsa; identical to SEQ ID NO: 757471

SEQ ID NO: 757505 - RNA, 62 nt, hsa; identical to SEQ ID NO: 757472

SEQ ID NO: 757506 - RNA, 62 nt, hsa; identical to SEQ ID NO: 757473

SEQ ID NO: 757507 - RNA, 64 nt, hsa; identical to SEQ ID NO: 365168

SEQ ID NO: 757508 - RNA, 64 nt, hsa; identical to SEQ ID NO: 365169

SEQ ID NO: 757509 - RNA, 64 nt, hsa; identical to SEQ ID NO: 365170

SEQ ID NO: 757510 - RNA, 64 nt, hsa; identical to SEQ ID NO: 365171

SEQ ID NO: 757511 - RNA, 64 nt, hsa; identical to SEQ ID NO: 365172

SEQ ID NO: 757512 - RNA, 64 nt, hsa; identical to SEQ ID NO: 365173

SEQ ID NO: 757513 - RNA, 64 nt, hsa; identical to SEQ ID NO: 365174

SEQ ID NO: 757514 - RNA, 64 nt, hsa; identical to SEQ ID NO: 365175

SEQ ID NO: 757515 - RNA, 64 nt, hsa; identical to SEQ ID NO: 365176

SEQ ID NO: 757516 - RNA, 64 nt, hsa; identical to SEQ ID NO: 365177

SEQ ID NO: 757517 - RNA, 64 nt, hsa; identical to SEQ ID NO: 365178

SEQ ID NO: 757518 - RNA, 64 nt, hsa; identical to SEQ ID NO: 365179

SEQ ID NO: 757519 - RNA, 64 nt, hsa; identical to SEQ ID NO: 365180

SEQ ID NO: 757520 - RNA, 64 nt, hsa; identical to SEQ ID NO: 365181

SEQ ID NO: 757521 - RNA, 64 nt, hsa; identical to SEQ ID NO: 365182

SEQ ID NO: 757522 - RNA, 64 nt, hsa; identical to SEQ ID NO: 365183

SEQ ID NO: 757523 - RNA, 64 nt, hsa; identical to SEQ ID NO: 365184

SEQ ID NO: 757524 - RNA, 64 nt, hsa; identical to SEQ ID NO: 365185

SEQ ID NO: 757525 - RNA, 64 nt, hsa; identical to SEQ ID NO: 365186

SEQ ID NO: 757526 - RNA, 64 nt, hsa; identical to SEQ ID NO: 365187

SEQ ID NO: 757527 - RNA, 64 nt, hsa; identical to SEQ ID NO: 365188

SEQ ID NO: 757528 - RNA, 64 nt, hsa; identical to SEQ ID NO: 365189

SEQ ID NO: 757529 - RNA, 64 nt, hsa; identical to SEQ ID NO: 365190

SEQ ID NO: 757530 - RNA, 64 nt, hsa; identical to SEQ ID NO: 365191

SEQ ID NO: 757531 - RNA, 64 nt, hsa; identical to SEQ ID NO: 365192

SEQ ID NO: 757532 - RNA, 64 nt, hsa; identical to SEQ ID NO: 365193

SEQ ID NO: 757533 - RNA, 51 nt, hsa; identical to SEQ ID NO: 365194

SEQ ID NO: 757534 - RNA, 64 nt, hsa; identical to SEQ ID NO: 365195

SEQ ID NO: 757535 - RNA, 64 nt, hsa; identical to SEQ ID NO: 365196

SEQ ID NO: 757536 - RNA, 64 nt, hsa; identical to SEQ ID NO: 365197

SEQ ID NO: 757537 - RNA, 64 nt, hsa; identical to SEQ ID NO: 365198

SEQ ID NO: 757538 - RNA, 64 nt, hsa; identical to SEQ ID NO: 365199

SEQ ID NO: 757539 - RNA, 64 nt, hsa; identical to SEQ ID NO: 365200

SEQ ID NO: 757540 - RNA, 64 nt, hsa; identical to SEQ ID NO: 365201

SEQ ID NO: 757541 - RNA, 64 nt, hsa; identical to SEQ ID NO: 365202

SEQ ID NO: 757542 - RNA, 64 nt, hsa; identical to SEQ ID NO: 365203

SEQ ID NO: 757543 - RNA, 64 nt, hsa; identical to SEQ ID NO: 365204

SEQ ID NO: 757544 - RNA, 62 nt, hsa
uucuuccacccucucacuuuccugccuguuccccacuccacaggagggagcugacguuggcu

SEQ ID NO: 757545 - RNA, 62 nt, hsa
agguuaauuucuaucucugaucccuccccaacccacuccauauuugggucauggacaguaaa

SEQ ID NO: 757546 - RNA, 62 nt, hsa
ucccuggcugccaaaacugcucagcaguugggccacuccacuauuccaccucucuaaaagaa

SEQ ID NO: 757547 - RNA, 62 nt, hsa
uuguucuucaucuccugucucuucaagccuccccacuccaccgugccgaaggagcucugcca

SEQ ID NO: 757548 - RNA, 62 nt, hsa
uggcgguugcugugagccaagaucaugccacuccacuccagucugggcgacagagcaagacu

SEQ ID NO: 757549 - RNA, 62 nt, hsa
ggagguggcgguugcugugagccaagaucaugccacuccacuccagucugggcgacagagca

SEQ ID NO: 757550 - RNA, 62 nt, hsa
accugcccaccuggggcuccugugcccccuccccacuccagaggccacccuacaaguugucc

SEQ ID NO: 757551 - RNA, 62 nt, hsa
gguagccacucuaggucguuggccuuccuugaccacuccauuuaauucucucugcuguuugg

SEQ ID NO: 757552 - RNA, 62 nt, hsa
ugacccuuccaccccgccucacucccuccgucccacuccacuccaggcugccggcaccugcc

SEQ ID NO: 757553 - RNA, 62 nt, hsa
cuuccaccccgccucacucccuccgucccacuccacuccaggcugccggcaccugccccauu

SEQ ID NO: 757554 - RNA, 62 nt, hsa
cuccagccugucccucuuagcacucuagcugcccacuccagggcagggacucgaaacccccu

SEQ ID NO: 757555 - RNA, 62 nt, hsa
ccaccgcccaggucuuaacuuucuggcauccaccacuccaugucucuggaugugucacuugg

SEQ ID NO: 757556 - RNA, 62 nt, hsa
aggggcucuccagaccccuuuuccaugaugacccacuccaagauauuauguguaaauugugu

SEQ ID NO: 757557 - RNA, 62 nt, hsa
cgugcccagcacaagugagccugguguggaaaccacuccauugcccgguggaauggauucug

SEQ ID NO: 757558 - RNA, 62 nt, hsa
gggccugggcagucugaagacugauaacuuccccacuccacccuacaagcagugggacuccu

SEQ ID NO: 757559 - RNA, 62 nt, hsa
gugcacacuuccaggccucccuggagagguguccacuccauccuucccuccguggcguaggg

SEQ ID NO: 757560 - RNA, 62 nt, hsa
aaagacaaggggccaggagccaacaccagaggccacuccacaaccccagcgccagucagcaa

SEQ ID NO: 757561 - RNA, 62 nt, hsa
gccacccaaacugccacuccacuccaggugggccacuccaaggaggcccuggcugcugccac

SEQ ID NO: 757562 - RNA, 62 nt, hsa
aucuucgccuagaagccacccaaacugccacuccacuccaggugggccacuccaaggaggcc

SEQ ID NO: 757563 - RNA, 62 nt, hsa
ggggcaucuucgccuagaagccacccaaacugccacuccacuccaggugggccacuccaagg

SEQ ID NO: 757564 - RNA, 62 nt, hsa
auaguccaucccgcuaguccaucccgcuagccccacuccagggacucagacccaucuccaac

SEQ ID NO: 757565 - RNA, 62 nt, hsa
uaugccuuccuguccuuucuacucaaugguccccacuccaagaugaguugacacaaccccuu

SEQ ID NO: 757566 - RNA, 62 nt, hsa
acccagaggaacccccaccccacccccaccuaccacuccaugcuuucucuacucccugccuc

SEQ ID NO: 757567 - RNA, 62 nt, hsa
ucugcagggagugagcuccccagacccccucgccacuccagcgcccaguccuucuccugccc

SEQ ID NO: 757568 - RNA, 62 nt, hsa
gcuccaucggcacuaaugcuccacucggcgccccacuccaucggccccgcuccaucggcacu

SEQ ID NO: 757569 - RNA, 62 nt, hsa
gcuccaucggcacuaaugccccacucggcgccccacuccaucagcacuaaugcuccacucca

SEQ ID NO: 757570 - RNA, 62 nt, hsa
acucggcgccccacuccaucagcacuaaugcuccacuccauuggcacuaacgccccaacucc

SEQ ID NO: 757571 - RNA, 62 nt, hsa
cacuaaugacccgcuccuuugacauuggugccccacuccaucagcacuaacgcccugcucca

SEQ ID NO: 757572 - RNA, 62 nt, hsa
cacuaacgcccugcuccaucggcacuggugucccacuccauugucacuaacguccggcucca

SEQ ID NO: 757573 - RNA, 62 nt, hsa
caggggacgggaugaggagcgggaggguuccgccacuccaguuuucuccucugcuucuuugc

SEQ ID NO: 757574 - RNA, 62 nt, hsa
cuucuuugccucccucagauagaaaacagcccccacuccaguccacuccugaccccucuccu

SEQ ID NO: 757575 - RNA, 62 nt, hsa
ucagcucugaaggccgugagaccccugauuucccacuccacacccuauauuucuguguaugu

SEQ ID NO: 757576 - RNA, 62 nt, hsa
gguugaggcugcagugagccgugauuucaccaccacuccagccugggugagaaagcaagacc

SEQ ID NO: 757577 - RNA, 62 nt, hsa; identical to SEQ ID NO: 355781

SEQ ID NO: 757578 - RNA, 62 nt, hsa
gccccccccuugaaucugcagggagcaacucuccacuccauauuuauuuaaacaauuuuuuc

SEQ ID NO: 757579 - RNA, 62 nt, hsa
aaguuucuuccccgaguggagcuucgacccacccacuccaggaacccagagccacauuagaa

SEQ ID NO: 757580 - RNA, 62 nt, hsa
gaacagauuuaaagacagguggccacugacagccacuccaggaacuugaacugcaggggcag

SEQ ID NO: 757581 - RNA, 64 nt, hsa
aaaaauacgacucuguugucuuacuugauauuucuugcccuaguaauguacuugacauuuaugu

SEQ ID NO: 757582 - RNA, 64 nt, hsa
accaucacccuuuuccccuuugguuuugaaggccuugcccuaagcuaccugaggguuuaggagg

SEQ ID NO: 757583 - RNA, 64 nt, hsa
cucagccugguaucagggaaauugagacuuauuuuugcccuaaaacgucucccuagcuguucuu

SEQ ID NO: 757584 - RNA, 64 nt, hsa
gugucugguccauugcuggcaguggacauuauucuugcccuaagagacacugccuuuucagcag

SEQ ID NO: 757585 - RNA, 64 nt, hsa
auuuugggucagacaucaaugucccuguccccccuggguccagccaagcugugccccauccccc

SEQ ID NO: 757586 - RNA, 64 nt, hsa
accccugcaccuucguuggagccccugcauccccuggguccagcccccucugcauuuacacaga

SEQ ID NO: 757587 - RNA, 64 nt, hsa
uuuuaggccaaggaaauauuuugugaugguguucuggguccauacaccagcaaugaaggagaua

SEQ ID NO: 757588 - RNA, 64 nt, hsa
uucgguuugagcuggauggguacagcuuaaaucauggguccagccuaaaaaccaccauuuaacu

SEQ ID NO: 757589 - RNA, 64 nt, hsa
agguagcugccccuggcucugaccgaaacagcgcuggguccaccccaugucaccggauccuggg

SEQ ID NO: 757590 - RNA, 64 nt, hsa
gagauggggugggguggagaacuccuaggguggcuggguccaggggaugggagguugugggcau

SEQ ID NO: 757591 - RNA, 64 nt, hsa
cuugugucuugggaacaaaaggccuuugagcauauggguccagccacucagaaguguaggggcc

SEQ ID NO: 757592 - RNA, 64 nt, hsa
gagucagauuuuuacagaggaggagggcagggcuuggguccaguggaggaagaaggaaggagag

SEQ ID NO: 757593 - RNA, 64 nt, hsa
cccuggagcacaggagaguagggaggagggguucuggguccaucacugcccuacaugugacuau

SEQ ID NO: 757594 - RNA, 64 nt, hsa
aaaaaccugccauuuucaccugcugaugcugcccuggguccagacucaagucagauacaacccu

SEQ ID NO: 757595 - RNA, 64 nt, hsa
ccuccaaugcugccugggagccagggugagagucuggguccaggccuggccauguggcccucca

SEQ ID NO: 757596 - RNA, 64 nt, hsa
aauacucugaauuuggagucugacugugcccaaguggguccaaguggcugugacaucuacguau

SEQ ID NO: 757597 - RNA, 64 nt, hsa
cuuuuagacaugguugugggucuggagggagacguggguccaagguccucaucccauccucccu

SEQ ID NO: 757598 - RNA, 64 nt, hsa
uccuggaaacagcaugaauaaaacacucaucccauggguccaaauuaauaugauucugcucccc

SEQ ID NO: 757599 - RNA, 64 nt, hsa
uguccagcccuguugcucuccuggcgcugagagguggguccaagcagaguugaucagucccugc

SEQ ID NO: 757600 - RNA, 64 nt, hsa
gaccaaaucgcugguugugcgcuuaacgugaggguggguccagugugcccugcgaugggucccg

SEQ ID NO: 757601 - RNA, 64 nt, hsa
ccgcggaauccugcagagcaaacucagguuaacuuggguccaugaccguuugcauucgaaacac

SEQ ID NO: 757602 - RNA, 64 nt, hsa
uaguuuaccuauucuacacuaacaaguguuguuuuggguccaugccuggaccaugucacaaaaa

SEQ ID NO: 757603 - RNA, 64 nt, hsa
ugcaguggagcccugagcagggcuggauaugggaaguaggcaaaugaaaugcgccaaggguuca

SEQ ID NO: 757604 - RNA, 54 nt, hsa
ucugcucaaagcucaccugaguggaguaggcauugccccagcccggucaggcuc

SEQ ID NO: 757605 - RNA, 64 nt, hsa
aaaugcuaugugccugacccaaugguaggcacauaguaggcacucaacucauauguuuaauuga

SEQ ID NO: 757606 - RNA, 64 nt, hsa
uuuguaaaaaggaaguauuucucccaaaauugggaguaggcaaacuacuaaucaguuuagcuuu

SEQ ID NO: 757607 - RNA, 64 nt, hsa
gcacuuuauaauaaagcauggaagaaauuaucuuaguaggcaauuguaacacuuuuugaaagua

SEQ ID NO: 757608 - RNA, 64 nt, hsa
caugaagaaugcagaagucaaacccucaugacaaaguaggcacaagucuacaauaagcuaaauc

SEQ ID NO: 757609 - RNA, 64 nt, hsa
gcccaggccagcacugccagccuccucucccugcaguaggcaccagcucuaccucccccggcag

SEQ ID NO: 757610 - RNA, 64 nt, hsa
caccccacccacuccauccuacccagggaccccaaguaggcaacuguuauggcaguggguccag

SEQ ID NO: 757611 - RNA, 61 nt, hsa
ccucccaggugggggaacugcuugggccuugcugagccaggguccucagggugaagcagga

SEQ ID NO: 757612 - RNA, 61 nt, hsa
ugccccauccccuuugagugucagaagcacucugagccaaggggacagggggcacgugcac

SEQ ID NO: 757613 - RNA, 61 nt, hsa
cccugguggucacaggcugugccuugguuuccugagccaccuuuacucugcucuaugccag

SEQ ID NO: 757614 - RNA, 61 nt, hsa
gggcgugccugccaagcucacacagcaggaacugagccagaaacgcagauugggcuggcuc

SEQ ID NO: 757615 - RNA, 61 nt, hsa
ucagaggauuauguaaccccugcaguggaaacugagccagcuaacuuaaaaagcugccuua

SEQ ID NO: 757616 - RNA, 61 nt, hsa
uauuagauucguaggucauauuacuuaucaacugagccaaaugucugugugcaauuguguu

SEQ ID NO: 757617 - RNA, 61 nt, hsa
uggggguuuggggcuaagaaguucaccagcccugagccauggcggccccucagccugccug

SEQ ID NO: 757618 - RNA, 61 nt, hsa
gcccugcccagccagccaucggaagagagggcugagccauggggguuuggggcuaagaagu

SEQ ID NO: 757619 - RNA, 61 nt, hsa
cuggaacauccugucaguuuggucauaaacccugagccagaugaaaugagccaccgugaac

SEQ ID NO: 757620 - RNA, 61 nt, hsa
acugaucugaaggagguggugcuucaggacucugagccauucucuccccuccucugcccug

SEQ ID NO: 757621 - RNA, 61 nt, hsa
gaccuccaccaccccugcagugggcugccagcugagccaccugucuuccacuguaucuacu

SEQ ID NO: 757622 - RNA, 61 nt, hsa
ucaaggcagcaguccccuuggauacuaaagucugagccaggccccucaggcccggcauggg

SEQ ID NO: 757623 - RNA, 61 nt, hsa
ggccauuaggcagccuaauuaaugcuggaggcugagccaaguacaggacacccccagccug

SEQ ID NO: 757624 - RNA, 61 nt, hsa
agcccucugccuccagggaggccaacugacucugagccaggguucccccagggaacucagu

SEQ ID NO: 757625 - RNA, 61 nt, hsa
gaguaugcgacggacagaggaacuaaucuaccugagccagaagauugaguuugagugcaaa

SEQ ID NO: 757626 - RNA, 61 nt, hsa
ucaucauuaaaaaaagggggaccauuggggccugagccaaggaacuuuccuucuacugccu

SEQ ID NO: 757627 - RNA, 61 nt, hsa
agccacgcugucuggugggugauucucugcccugagccaccacccuggacuggcccagucu

SEQ ID NO: 757628 - RNA, 61 nt, hsa
gucacugccucaggacccccaagccuaugcccugagccauggcugcugacugacuccagcc

SEQ ID NO: 757629 - RNA, 61 nt, hsa
uaguucagauacagggugcuccuugucaauacugagccauuuauaccuuugaaauauuaaa

SEQ ID NO: 757630 - RNA, 61 nt, hsa
ugaaugugaagcaaacacagcaucgugaucacugagccaucauuuccugggagaaagacca

SEQ ID NO: 757631 - RNA, 61 nt, hsa
agggguuaucugggagaagcuuuagccuguucugagccauuaggagacauuagugaauugg

SEQ ID NO: 757632 - RNA, 61 nt, hsa
cccaccagagauguggucauaagaucugauccugagccagagauucagauggcacaggaag

SEQ ID NO: 757633 - RNA, 61 nt, hsa
ccaggauacgcccgagcggaagaagcgggcucugagccacgcccuuucacccuccucuacc

SEQ ID NO: 757634 - RNA, 61 nt, hsa
cugguuuccccaacaggcugcguaagggacccugagccacagugaguuggucaaaugcucc

SEQ ID NO: 757635 - RNA, 61 nt, hsa
acuucugaggagcagaguugagggagccgagcugagccacgcugggaggccagagccuuuc

SEQ ID NO: 757636 - RNA, 61 nt, hsa
ggauccucagccauguucaagugaaguaagccugagccagugcguggacuggugccacggg

SEQ ID NO: 757637 - RNA, 61 nt, hsa
cucuucugcacagcuccuccccugcuaccugcugagccagauuccccaggaaucuugaaug

SEQ ID NO: 757638 - RNA, 61 nt, hsa
accucuucuucuccaaaggaucuuuguuccucugagccaagacugagguaaauaaagccac

SEQ ID NO: 757639 - RNA, 61 nt, hsa
caucuggucuugguagaugucccuagacgggcugagccaugugcaauaagaacauagaucc

SEQ ID NO: 757640 - RNA, 61 nt, hsa
gaaaucccuggagaauuuuuggugacaugcacugagccaaggugauggacuguauauuuga

SEQ ID NO: 757641 - RNA, 61 nt, hsa
auggauggacagacaggccauggaggcagcacugagccagcaccacacguccauccuggga

SEQ ID NO: 757642 - RNA, 61 nt, hsa
cacacagggagacgggggccuggagccagcccugagccagaggcagaauggauggacagac

SEQ ID NO: 757643 - RNA, 61 nt, hsa
ucaccuuguugguaccucccucccuggaucucugagccagcagccaggaggaccugaccca

SEQ ID NO: 757644 - RNA, 61 nt, hsa
cggucagcacagugccuuuuccucuccugcucugagccaggguggggcauucccucuagau

SEQ ID NO: 757645 - RNA, 61 nt, hsa
gggcacuuucaccaagauguucuagaaacuucugagccaggagugaauggcccuuccuuag

SEQ ID NO: 757646 - RNA, 61 nt, hsa
cauucccagggcacuccuuaccccugcugcccugagccaacgccuucacggaccucccuag

SEQ ID NO: 757647 - RNA, 61 nt, hsa
auugacuuucuguugagguaccuuggagaagcugagccauucugaggacaucuggcugugu

SEQ ID NO: 757648 - RNA, 61 nt, hsa
gccuugggucaguccagcccccuccacaucacugagccaucaaugagcugagagaucaaug

SEQ ID NO: 757649 - RNA, 61 nt, hsa
aggggcucugagcccgggccacgcaggggcccugagccaaaagagggggagaaugagaagg

SEQ ID NO: 757650 - RNA, 61 nt, hsa
ccccuccagucguuauuucuguuuguuuaagcugagccacggauaccgccacggguuuccc

SEQ ID NO: 757651 - RNA, 61 nt, hsa
uggaacccaauaccuaggcuuacaggccauccugagccaggggccucuggaaauucucuuc

SEQ ID NO: 757652 - RNA, 61 nt, hsa
cuggauguuccccagcuggcaguugagcugccugagccaaugugucugucuuugguaacug

SEQ ID NO: 757653 - RNA, 61 nt, hsa
ggauguccagagcuggccaggccacugggcccugagccagagacaaggucaccugggcugu

SEQ ID NO: 757654 - RNA, 61 nt, hsa
ucccgacucugauaccuucuggcugugcuaccugagccaagucgccuccccucucugggcu

SEQ ID NO: 757655 - RNA, 61 nt, hsa
cucauucacccaaccucaggguucuccccaucugagccagccugcuggugugacuuacuca

SEQ ID NO: 757656 - RNA, 61 nt, hsa
cauccuccauuccucugcacuugcagacuuucugagccaggguuuucuuuuaguggaaaca

SEQ ID NO: 757657 - RNA, 61 nt, hsa
augugcaccuguagucccagcuacucgggggcugagccaggcggauagcuugagcucaggg

SEQ ID NO: 757658 - RNA, 61 nt, hsa
cccguaccacuguugaugugaagcaccucuucugagccaggccgagccccuggccgacuug

SEQ ID NO: 757659 - RNA, 61 nt, hsa
cuggcugggacugacuuggccauguucucagcugagccacgcggcugguagugcagccuuc

SEQ ID NO: 757660 - RNA, 61 nt, hsa
aagggauuucuggcucaggcuguaaaaguagcugagccauccugcccauuccuggaggucc

SEQ ID NO: 757661 - RNA, 61 nt, hsa
ggugauuucaaugauggcauccaggaauuagcugagccaacagaccauguggacagcuuug

SEQ ID NO: 757662 - RNA, 61 nt, hsa
gcugaccugccuagcgagcaggacaucccuucugagccaucugcugcucucucauuucauc

SEQ ID NO: 757663 - RNA, 61 nt, hsa
agcagggugguccugcguccacuucccaagccugagccaagcucaucuucauugaaugucu

SEQ ID NO: 757664 - RNA, 61 nt, hsa
ccuccuguuggagggguggagggauguuccccugagccaggcugagacuagaaccccaucu

SEQ ID NO: 757665 - RNA, 61 nt, hsa
gagccaggcugagacuagaaccccaucuucccugagccaggcugagacuagaaccccaucu

SEQ ID NO: 757666 - RNA, 61 nt, hsa
ugggcugaggcaggggccgcugucgucaggccugagccagggugagcuggugccugccuug

SEQ ID NO: 757667 - RNA, 61 nt, hsa
acacaaucaguggggcagccagagcucagaccugagccauuuugucaguauccaggacccc

SEQ ID NO: 757668 - RNA, 61 nt, hsa
ggaaacccguuguuccucccgucuucagaugcugagccaacugcuuggacagcagccagcg

SEQ ID NO: 757669 - RNA, 61 nt, hsa
agaugucuuaaaagacuagaauccacacuuccugagccagaggggccguguugacgguaau

SEQ ID NO: 757670 - RNA, 64 nt, hsa
ggucaccaucuaacuauucaggaauuguagucugagggcguagacaauuucauauaauaaauau

SEQ ID NO: 757671 - RNA, 64 nt, hsa
agugccauccugacucuagaaggccccccacagcagggcguagggggcaucacccugcucacuc

SEQ ID NO: 757672 - RNA, 64 nt, hsa
aguaaguuucgauaaauaauuguugcaucacagaagggcguauuucgaaaaccagaguacaguc

SEQ ID NO: 757673 - RNA, 64 nt, hsa
uggguugaaaauuuggaccuucacugacuuaugcagggcguauauuuuguugagcccuuccucc

SEQ ID NO: 757674 - RNA, 64 nt, hsa
aucccuaguuguuugaauuaacugaauaaagugcagggcguaauagugacuggcugggggcacu

SEQ ID NO: 757675 - RNA, 51 nt, hsa
agaagauaacuaccguuuagcagggcguacugcgguuggugacgggggucc

SEQ ID NO: 757676 - RNA, 64 nt, hsa
cuuguccuccccuccuccaccccccagguugugaagggcguaacuuuuagagggaacggccacu

SEQ ID NO: 757677 - RNA, 64 nt, hsa
uuccuguuuacaacaugucaaagccauugguucaagggcguaauaaauacuugcguauucaaug

SEQ ID NO: 757678 - RNA, 64 nt, hsa
uggaauaagauguauucucacucccuugaucucaagggcguaacucuggaagcacagcuugacu

SEQ ID NO: 757679 - RNA, 64 nt, hsa
uaucacaagacacgccugcauguagaccagacacagggcguauggaaagcacguccucaagacu

SEQ ID NO: 757680 - RNA, 64 nt, hsa
gagugaaggcuuuuuccccuaauccuggcagagcagggcguagaaaagagaggauguccgugcu

SEQ ID NO: 757681 - RNA, 64 nt, hsa
cugagcucucggcuccuccuccgucuucagggccagggcguagcgucugcucucucggccucug

SEQ ID NO: 757682 - RNA, 58 nt, hsa
gcccaggcugcacaccgugaagauguggagggcguagggugggggcagugaggaaugg

SEQ ID NO: 757683 - RNA, 64 nt, hsa
ucucuggcacaaggggagccccagggcuugggggagggcguaagguggggggaaaugccacugc

SEQ ID NO: 757684 - RNA, 64 nt, hsa
aagccugccacucuuuaccuagucccugcuguguagggcguaguccagguuagcuagguagagu

SEQ ID NO: 757685 - RNA, 64 nt, hsa
gcacgcacacggccccgcacacagccccgccccaccccgcaaccagcccugucgacugccuuau

SEQ ID NO: 757686 - RNA, 64 nt, hsa
ccccaccccacccacccucggggcgccccccuccccccgcaagccagccugggccagccccgcu

SEQ ID NO: 757687 - RNA, 64 nt, hsa; identical to SEQ ID NO: 95465

SEQ ID NO: 757688 - RNA, 64 nt, hsa; identical to SEQ ID NO: 95466

SEQ ID NO: 757689 - RNA, 64 nt, hsa; identical to SEQ ID NO: 95467

SEQ ID NO: 757690 - RNA, 64 nt, hsa; identical to SEQ ID NO: 95468

SEQ ID NO: 757691 - RNA, 64 nt, hsa; identical to SEQ ID NO: 95469

SEQ ID NO: 757692 - RNA, 64 nt, hsa; identical to SEQ ID NO: 95470

SEQ ID NO: 757693 - RNA, 64 nt, hsa; identical to SEQ ID NO: 95471

SEQ ID NO: 757694 - RNA, 64 nt, hsa; identical to SEQ ID NO: 95472

SEQ ID NO: 757695 - RNA, 64 nt, hsa; identical to SEQ ID NO: 95473

SEQ ID NO: 757696 - RNA, 64 nt, hsa; identical to SEQ ID NO: 95474

SEQ ID NO: 757697 - RNA, 64 nt, hsa; identical to SEQ ID NO: 95475

SEQ ID NO: 757698 - RNA, 64 nt, hsa; identical to SEQ ID NO: 95476

SEQ ID NO: 757699 - RNA, 64 nt, hsa; identical to SEQ ID NO: 95477

SEQ ID NO: 757700 - RNA, 64 nt, hsa; identical to SEQ ID NO: 141401

SEQ ID NO: 757701 - RNA, 64 nt, hsa; identical to SEQ ID NO: 141402

SEQ ID NO: 757702 - RNA, 64 nt, hsa; identical to SEQ ID NO: 98595

SEQ ID NO: 757703 - RNA, 64 nt, hsa; identical to SEQ ID NO: 98596

SEQ ID NO: 757704 - RNA, 64 nt, hsa; identical to SEQ ID NO: 98597

SEQ ID NO: 757705 - RNA, 64 nt, hsa; identical to SEQ ID NO: 98598

SEQ ID NO: 757706 - RNA, 64 nt, hsa; identical to SEQ ID NO: 98599

SEQ ID NO: 757707 - RNA, 64 nt, hsa; identical to SEQ ID NO: 98600

SEQ ID NO: 757708 - RNA, 64 nt, hsa; identical to SEQ ID NO: 98601

SEQ ID NO: 757709 - RNA, 64 nt, hsa; identical to SEQ ID NO: 98602

SEQ ID NO: 757710 - RNA, 64 nt, hsa; identical to SEQ ID NO: 98603

SEQ ID NO: 757711 - RNA, 64 nt, hsa; identical to SEQ ID NO: 98604

SEQ ID NO: 757712 - RNA, 64 nt, hsa; identical to SEQ ID NO: 98605

SEQ ID NO: 757713 - RNA, 64 nt, hsa; identical to SEQ ID NO: 98606

SEQ ID NO: 757714 - RNA, 64 nt, hsa; identical to SEQ ID NO: 98607

SEQ ID NO: 757715 - RNA, 64 nt, hsa; identical to SEQ ID NO: 98608

SEQ ID NO: 757716 - RNA, 64 nt, hsa; identical to SEQ ID NO: 98609

SEQ ID NO: 757717 - RNA, 64 nt, hsa; identical to SEQ ID NO: 98610

SEQ ID NO: 757718 - RNA, 64 nt, hsa; identical to SEQ ID NO: 98611

SEQ ID NO: 757719 - RNA, 64 nt, hsa; identical to SEQ ID NO: 98612

SEQ ID NO: 757720 - RNA, 64 nt, hsa; identical to SEQ ID NO: 98613

SEQ ID NO: 757721 - RNA, 64 nt, hsa; identical to SEQ ID NO: 98614

SEQ ID NO: 757722 - RNA, 64 nt, hsa; identical to SEQ ID NO: 98615

SEQ ID NO: 757723 - RNA, 57 nt, hsa; identical to SEQ ID NO: 98616

SEQ ID NO: 757724 - RNA, 64 nt, hsa; identical to SEQ ID NO: 98617

SEQ ID NO: 757725 - RNA, 64 nt, hsa; identical to SEQ ID NO: 98618

SEQ ID NO: 757726 - RNA, 64 nt, hsa; identical to SEQ ID NO: 98619

SEQ ID NO: 757727 - RNA, 64 nt, hsa; identical to SEQ ID NO: 98620

SEQ ID NO: 757728 - RNA, 64 nt, hsa; identical to SEQ ID NO: 98621

SEQ ID NO: 757729 - RNA, 64 nt, hsa; identical to SEQ ID NO: 98622

SEQ ID NO: 757730 - RNA, 64 nt, hsa; identical to SEQ ID NO: 98623

SEQ ID NO: 757731 - RNA, 64 nt, hsa; identical to SEQ ID NO: 98624

SEQ ID NO: 757732 - RNA, 64 nt, hsa; identical to SEQ ID NO: 98625

SEQ ID NO: 757733 - RNA, 64 nt, hsa; identical to SEQ ID NO: 98626

SEQ ID NO: 757734 - RNA, 64 nt, hsa; identical to SEQ ID NO: 98627

SEQ ID NO: 757735 - RNA, 64 nt, hsa; identical to SEQ ID NO: 98628

SEQ ID NO: 757736 - RNA, 64 nt, hsa; identical to SEQ ID NO: 98629

SEQ ID NO: 757737 - RNA, 64 nt, hsa; identical to SEQ ID NO: 98630

SEQ ID NO: 757738 - RNA, 64 nt, hsa; identical to SEQ ID NO: 98631

SEQ ID NO: 757739 - RNA, 64 nt, hsa; identical to SEQ ID NO: 98632

SEQ ID NO: 757740 - RNA, 64 nt, hsa; identical to SEQ ID NO: 98633

SEQ ID NO: 757741 - RNA, 64 nt, hsa; identical to SEQ ID NO: 98634

SEQ ID NO: 757742 - RNA, 64 nt, hsa; identical to SEQ ID NO: 98635

SEQ ID NO: 757743 - RNA, 64 nt, hsa; identical to SEQ ID NO: 98636

SEQ ID NO: 757744 - RNA, 64 nt, hsa; identical to SEQ ID NO: 98637

SEQ ID NO: 757745 - RNA, 64 nt, hsa; identical to SEQ ID NO: 98638

SEQ ID NO: 757746 - RNA, 64 nt, hsa; identical to SEQ ID NO: 98639

SEQ ID NO: 757747 - RNA, 64 nt, hsa; identical to SEQ ID NO: 98640

SEQ ID NO: 757748 - RNA, 64 nt, hsa; identical to SEQ ID NO: 98641

SEQ ID NO: 757749 - RNA, 64 nt, hsa; identical to SEQ ID NO: 98642

SEQ ID NO: 757750 - RNA, 64 nt, hsa; identical to SEQ ID NO: 98643

SEQ ID NO: 757751 - RNA, 64 nt, hsa; identical to SEQ ID NO: 98644

SEQ ID NO: 757752 - RNA, 64 nt, hsa; identical to SEQ ID NO: 98645

SEQ ID NO: 757753 - RNA, 64 nt, hsa; identical to SEQ ID NO: 98646

SEQ ID NO: 757754 - RNA, 64 nt, hsa; identical to SEQ ID NO: 98647

SEQ ID NO: 757755 - RNA, 64 nt, hsa; identical to SEQ ID NO: 98648

SEQ ID NO: 757756 - RNA, 64 nt, hsa; identical to SEQ ID NO: 98649

SEQ ID NO: 757757 - RNA, 64 nt, hsa; identical to SEQ ID NO: 98650

SEQ ID NO: 757758 - RNA, 64 nt, hsa; identical to SEQ ID NO: 98651

SEQ ID NO: 757759 - RNA, 64 nt, hsa; identical to SEQ ID NO: 98652

SEQ ID NO: 757760 - RNA, 64 nt, hsa; identical to SEQ ID NO: 98653

SEQ ID NO: 757761 - RNA, 64 nt, hsa; identical to SEQ ID NO: 98654

SEQ ID NO: 757762 - RNA, 64 nt, hsa; identical to SEQ ID NO: 98655

SEQ ID NO: 757763 - RNA, 64 nt, hsa; identical to SEQ ID NO: 98656

SEQ ID NO: 757764 - RNA, 64 nt, hsa; identical to SEQ ID NO: 98657

SEQ ID NO: 757765 - RNA, 64 nt, hsa; identical to SEQ ID NO: 98658

SEQ ID NO: 757766 - RNA, 64 nt, hsa; identical to SEQ ID NO: 98659

SEQ ID NO: 757767 - RNA, 64 nt, hsa; identical to SEQ ID NO: 98660

SEQ ID NO: 757768 - RNA, 64 nt, hsa; identical to SEQ ID NO: 98661

SEQ ID NO: 757769 - RNA, 64 nt, hsa; identical to SEQ ID NO: 98662

SEQ ID NO: 757770 - RNA, 64 nt, hsa; identical to SEQ ID NO: 98663

SEQ ID NO: 757771 - RNA, 64 nt, hsa; identical to SEQ ID NO: 98664

SEQ ID NO: 757772 - RNA, 64 nt, hsa; identical to SEQ ID NO: 98665

SEQ ID NO: 757773 - RNA, 64 nt, hsa; identical to SEQ ID NO: 98666

SEQ ID NO: 757774 - RNA, 64 nt, hsa; identical to SEQ ID NO: 98667

SEQ ID NO: 757775 - RNA, 64 nt, hsa; identical to SEQ ID NO: 98668

SEQ ID NO: 757776 - RNA, 64 nt, hsa; identical to SEQ ID NO: 98669

SEQ ID NO: 757777 - RNA, 64 nt, hsa; identical to SEQ ID NO: 98670

SEQ ID NO: 757778 - RNA, 64 nt, hsa; identical to SEQ ID NO: 98671

SEQ ID NO: 757779 - RNA, 62 nt, hsa
ggcccuccaccuguggcucacaucucgccagccccacagagcauccucaggccucuccaagg

SEQ ID NO: 757780 - RNA, 62 nt, hsa
cucaaccuccggaguccaggagaacccguacccccacagagccuuaagcaacuacuucugug

SEQ ID NO: 757781 - RNA, 62 nt, hsa
cgucagcccgaguucugaauuaaaacaugccucccacagaaucuauuucugaugaauaugaa

SEQ ID NO: 757782 - RNA, 62 nt, hsa
ugaggccuccccagaagcagaagcauguaaagcccacagaaccgugaguugauuaaaucucu

SEQ ID NO: 757783 - RNA, 62 nt, hsa
ucucggaccucgcuguguuucacugccuccugcccacagacccaggccugccggcccggacc

SEQ ID NO: 757784 - RNA, 62 nt, hsa
caaguggacacauggcugugcaggccaggaggcccacagauggacugagugcugggaagggg

SEQ ID NO: 757785 - RNA, 62 nt, hsa
cugccacauggagucuugccaugccugugugccccacagaccuaauauauguccggacagcu

SEQ ID NO: 757786 - RNA, 62 nt, hsa
acugucaugcaggucauaucagaucugagugccccacagagucacagugugucuggacagcc

SEQ ID NO: 757787 - RNA, 62 nt, hsa
caagaugguguucugcuaauguuaaaugucagcccacagagcuaauaauaccucaguauaau

SEQ ID NO: 757788 - RNA, 62 nt, hsa
aacaacaagguuaagcuucaucugcuuggugucccacagaacuugcacaagcaguuguuauu

SEQ ID NO: 757789 - RNA, 62 nt, hsa
ugagaccuuggcucuguauggaggcugcucaccccacagacacugguggggagaccauggcu

SEQ ID NO: 757790 - RNA, 62 nt, hsa
gaggagaggaaacagugacuaaaagcuggggacccacagagggguuggcagcuucucuuguc

SEQ ID NO: 757791 - RNA, 62 nt, hsa
ggccccacagaccccacagaggaugaagccaccccacagaggaugcagcccccagcugcaug

SEQ ID NO: 757792 - RNA, 62 nt, hsa
aaugcugaugacuuggagcaggccccacagaccccacagaggaugaagccaccccacagagg

SEQ ID NO: 757793 - RNA, 62 nt, hsa
ugggcauggaaugcugaugacuuggagcaggccccacagaccccacagaggaugaagccacc

SEQ ID NO: 757794 - RNA, 62 nt, hsa
acacugaaagcugaguccugccgucugucucacccacagaugucuguagucggucgguguga

SEQ ID NO: 757795 - RNA, 62 nt, hsa
ccagauucucaagcagaugcccaagggagguccccacagagccagagugccugaggcuuccu

SEQ ID NO: 757796 - RNA, 62 nt, hsa
aaaugauugauaauaggaaugaguuaccucuucccacagacauuuguuuuuaaguaugacag

SEQ ID NO: 757797 - RNA, 62 nt, hsa
uauuuuccagagucucuaaacucucaucuucccccacagauacacauccaagcucacaaaua

SEQ ID NO: 757798 - RNA, 62 nt, hsa
gacccccagagccaagguggcugggaucuggccccacagauggggaaagauggggaagggug

SEQ ID NO: 757799 - RNA, 62 nt, hsa
cuccauaugcaaucaguagcgagcagccgggccccacagacccucaugcacucucuuacgug

SEQ ID NO: 757800 - RNA, 62 nt, hsa
gaauccugacugcaaggcccaccugccccucccccacagagccuccagagcuagcugaggcc

SEQ ID NO: 757801 - RNA, 62 nt, hsa
gggcaacggcuccccauuuuucccgagccccgcccacagagcucuuagccaauccuaugcag

SEQ ID NO: 757802 - RNA, 62 nt, hsa
caaauuugcugggagagggaaagacauucagacccacagaaaggaggcagcacacagagaaa

SEQ ID NO: 757803 - RNA, 62 nt, hsa
ggggagguuggucagggaagagagggguucuacccacagaucaacuguguaaucuuuuacua

SEQ ID NO: 757804 - RNA, 62 nt, hsa
gcaggagcauagaauaguuuggguaccaggaacccacagaggcacacaugaaaagccaaauu

SEQ ID NO: 757805 - RNA, 62 nt, hsa
uagucuccauuucauagaugaaaauagugaagcccacagaaaauaaguagcuccuccacagg

SEQ ID NO: 757806 - RNA, 62 nt, hsa
agggaccacccuccccacaguaugcacucagccccacagaacccaccagucuuucugggaac

SEQ ID NO: 757807 - RNA, 62 nt, hsa
gaguccccagccucccucagguuacucugcaccccacagaugguuugauggcugugcuguau

SEQ ID NO: 757808 - RNA, 62 nt, hsa
cugcuccccacacggacuccaggcgguccccacccacagaagcagaccuucagcucagguaa

SEQ ID NO: 757809 - RNA, 62 nt, hsa
ggguggcccuggaggccccugaccccaccccacccacagagcacgagggccccgucagcuca

SEQ ID NO: 757810 - RNA, 62 nt, hsa
acgggaugcuuugaagauaccaugaaauaaaacccacagagguauuugauguauuuaauugu

SEQ ID NO: 757811 - RNA, 62 nt, hsa
agggacuugcaguggauucuuggucaggugugcccacagaugcggaggcgaggugagugauu

SEQ ID NO: 757812 - RNA, 62 nt, hsa
aagguggugagggcggaggggccgcuccaggccccacagagcaggagacccccagagaaagc

SEQ ID NO: 757813 - RNA, 62 nt, hsa
gugaguuuggugcaugcaaaccugugugcucacccacagagcaugggguaaugguguguaga

SEQ ID NO: 757814 - RNA, 62 nt, hsa
ucagcccaacugcaggugguaggauaggggugcccacagagggcaaagaaacugcccauggu

SEQ ID NO: 757815 - RNA, 62 nt, hsa
cugugcuggccugugcucaacacgggccccuccccacagaaagcugcuccuggaugccccug

SEQ ID NO: 757816 - RNA, 64 nt, hsa; identical to SEQ ID NO: 376674

SEQ ID NO: 757817 - RNA, 64 nt, hsa; identical to SEQ ID NO: 376675

SEQ ID NO: 757818 - RNA, 64 nt, hsa; identical to SEQ ID NO: 376676

SEQ ID NO: 757819 - RNA, 64 nt, hsa; identical to SEQ ID NO: 376677

SEQ ID NO: 757820 - RNA, 64 nt, hsa; identical to SEQ ID NO: 376678

SEQ ID NO: 757821 - RNA, 64 nt, hsa; identical to SEQ ID NO: 376679

SEQ ID NO: 757822 - RNA, 64 nt, hsa; identical to SEQ ID NO: 376680

SEQ ID NO: 757823 - RNA, 64 nt, hsa; identical to SEQ ID NO: 376681

SEQ ID NO: 757824 - RNA, 64 nt, hsa; identical to SEQ ID NO: 376682

SEQ ID NO: 757825 - RNA, 64 nt, hsa; identical to SEQ ID NO: 376683

SEQ ID NO: 757826 - RNA, 64 nt, hsa; identical to SEQ ID NO: 376684

SEQ ID NO: 757827 - RNA, 64 nt, hsa; identical to SEQ ID NO: 376685

SEQ ID NO: 757828 - RNA, 64 nt, hsa; identical to SEQ ID NO: 376686

SEQ ID NO: 757829 - RNA, 64 nt, hsa; identical to SEQ ID NO: 376687

SEQ ID NO: 757830 - RNA, 64 nt, hsa; identical to SEQ ID NO: 376688

SEQ ID NO: 757831 - RNA, 64 nt, hsa; identical to SEQ ID NO: 376689

SEQ ID NO: 757832 - RNA, 64 nt, hsa; identical to SEQ ID NO: 376690

SEQ ID NO: 757833 - RNA, 64 nt, hsa; identical to SEQ ID NO: 376691

SEQ ID NO: 757834 - RNA, 64 nt, hsa; identical to SEQ ID NO: 376692

SEQ ID NO: 757835 - RNA, 64 nt, hsa; identical to SEQ ID NO: 376693

SEQ ID NO: 757836 - RNA, 64 nt, hsa; identical to SEQ ID NO: 376694

SEQ ID NO: 757837 - RNA, 64 nt, hsa; identical to SEQ ID NO: 376695

SEQ ID NO: 757838 - RNA, 64 nt, hsa; identical to SEQ ID NO: 376696

SEQ ID NO: 757839 - RNA, 64 nt, hsa; identical to SEQ ID NO: 376697

SEQ ID NO: 757840 - RNA, 64 nt, hsa; identical to SEQ ID NO: 376698

SEQ ID NO: 757841 - RNA, 64 nt, hsa; identical to SEQ ID NO: 376699

SEQ ID NO: 757842 - RNA, 64 nt, hsa; identical to SEQ ID NO: 376700

SEQ ID NO: 757843 - RNA, 64 nt, hsa; identical to SEQ ID NO: 376701

SEQ ID NO: 757844 - RNA, 64 nt, hsa; identical to SEQ ID NO: 376702

SEQ ID NO: 757845 - RNA, 64 nt, hsa; identical to SEQ ID NO: 376703

SEQ ID NO: 757846 - RNA, 64 nt, hsa; identical to SEQ ID NO: 376704

SEQ ID NO: 757847 - RNA, 64 nt, hsa; identical to SEQ ID NO: 376705

SEQ ID NO: 757848 - RNA, 64 nt, hsa; identical to SEQ ID NO: 376706

SEQ ID NO: 757849 - RNA, 64 nt, hsa; identical to SEQ ID NO: 376707

SEQ ID NO: 757850 - RNA, 64 nt, hsa; identical to SEQ ID NO: 376708

SEQ ID NO: 757851 - RNA, 64 nt, hsa; identical to SEQ ID NO: 376709

SEQ ID NO: 757852 - RNA, 64 nt, hsa; identical to SEQ ID NO: 376710

SEQ ID NO: 757853 - RNA, 64 nt, hsa; identical to SEQ ID NO: 376711

SEQ ID NO: 757854 - RNA, 64 nt, hsa; identical to SEQ ID NO: 376712

SEQ ID NO: 757855 - RNA, 64 nt, hsa; identical to SEQ ID NO: 376713

SEQ ID NO: 757856 - RNA, 64 nt, hsa; identical to SEQ ID NO: 376714

SEQ ID NO: 757857 - RNA, 64 nt, hsa; identical to SEQ ID NO: 376715

SEQ ID NO: 757858 - RNA, 64 nt, hsa; identical to SEQ ID NO: 376716

SEQ ID NO: 757859 - RNA, 64 nt, hsa; identical to SEQ ID NO: 376717

SEQ ID NO: 757860 - RNA, 64 nt, hsa; identical to SEQ ID NO: 376718

SEQ ID NO: 757861 - RNA, 64 nt, hsa; identical to SEQ ID NO: 376719

SEQ ID NO: 757862 - RNA, 64 nt, hsa; identical to SEQ ID NO: 376720

SEQ ID NO: 757863 - RNA, 64 nt, hsa; identical to SEQ ID NO: 376721

SEQ ID NO: 757864 - RNA, 64 nt, hsa; identical to SEQ ID NO: 376722

SEQ ID NO: 757865 - RNA, 64 nt, hsa; identical to SEQ ID NO: 376723

SEQ ID NO: 757866 - RNA, 64 nt, hsa; identical to SEQ ID NO: 376724

SEQ ID NO: 757867 - RNA, 64 nt, hsa; identical to SEQ ID NO: 376725

SEQ ID NO: 757868 - RNA, 64 nt, hsa; identical to SEQ ID NO: 376726

SEQ ID NO: 757869 - RNA, 64 nt, hsa; identical to SEQ ID NO: 376727

SEQ ID NO: 757870 - RNA, 64 nt, hsa; identical to SEQ ID NO: 376728

SEQ ID NO: 757871 - RNA, 64 nt, hsa; identical to SEQ ID NO: 376729

SEQ ID NO: 757872 - RNA, 64 nt, hsa; identical to SEQ ID NO: 376730

SEQ ID NO: 757873 - RNA, 64 nt, hsa; identical to SEQ ID NO: 376731

SEQ ID NO: 757874 - RNA, 62 nt, hsa; identical to SEQ ID NO: 376732

SEQ ID NO: 757875 - RNA, 64 nt, hsa; identical to SEQ ID NO: 376733

SEQ ID NO: 757876 - RNA, 64 nt, hsa; identical to SEQ ID NO: 376734

SEQ ID NO: 757877 - RNA, 55 nt, hsa; identical to SEQ ID NO: 376735

SEQ ID NO: 757878 - RNA, 64 nt, hsa; identical to SEQ ID NO: 376736

SEQ ID NO: 757879 - RNA, 64 nt, hsa; identical to SEQ ID NO: 376737

SEQ ID NO: 757880 - RNA, 64 nt, hsa; identical to SEQ ID NO: 376738

SEQ ID NO: 757881 - RNA, 64 nt, hsa; identical to SEQ ID NO: 376739

SEQ ID NO: 757882 - RNA, 64 nt, hsa; identical to SEQ ID NO: 376740

SEQ ID NO: 757883 - RNA, 64 nt, hsa; identical to SEQ ID NO: 376741

SEQ ID NO: 757884 - RNA, 64 nt, hsa; identical to SEQ ID NO: 376742

SEQ ID NO: 757885 - RNA, 64 nt, hsa; identical to SEQ ID NO: 376743

SEQ ID NO: 757886 - RNA, 64 nt, hsa; identical to SEQ ID NO: 376744

SEQ ID NO: 757887 - RNA, 64 nt, hsa; identical to SEQ ID NO: 376745

SEQ ID NO: 757888 - RNA, 64 nt, hsa; identical to SEQ ID NO: 376746

SEQ ID NO: 757889 - RNA, 64 nt, hsa; identical to SEQ ID NO: 376747

SEQ ID NO: 757890 - RNA, 64 nt, hsa; identical to SEQ ID NO: 376748

SEQ ID NO: 757891 - RNA, 64 nt, hsa; identical to SEQ ID NO: 376749

SEQ ID NO: 757892 - RNA, 64 nt, hsa; identical to SEQ ID NO: 376750

SEQ ID NO: 757893 - RNA, 64 nt, hsa; identical to SEQ ID NO: 376751

SEQ ID NO: 757894 - RNA, 64 nt, hsa; identical to SEQ ID NO: 376752

SEQ ID NO: 757895 - RNA, 64 nt, hsa; identical to SEQ ID NO: 376753

SEQ ID NO: 757896 - RNA, 64 nt, hsa; identical to SEQ ID NO: 376754

SEQ ID NO: 757897 - RNA, 64 nt, hsa; identical to SEQ ID NO: 376755

SEQ ID NO: 757898 - RNA, 64 nt, hsa; identical to SEQ ID NO: 376756

SEQ ID NO: 757899 - RNA, 64 nt, hsa; identical to SEQ ID NO: 376757

SEQ ID NO: 757900 - RNA, 64 nt, hsa; identical to SEQ ID NO: 376758

SEQ ID NO: 757901 - RNA, 64 nt, hsa; identical to SEQ ID NO: 376759

SEQ ID NO: 757902 - RNA, 64 nt, hsa; identical to SEQ ID NO: 376760

SEQ ID NO: 757903 - RNA, 64 nt, hsa; identical to SEQ ID NO: 376761

SEQ ID NO: 757904 - RNA, 64 nt, hsa; identical to SEQ ID NO: 376762

SEQ ID NO: 757905 - RNA, 64 nt, hsa; identical to SEQ ID NO: 376763

SEQ ID NO: 757906 - RNA, 64 nt, hsa; identical to SEQ ID NO: 376764

SEQ ID NO: 757907 - RNA, 64 nt, hsa; identical to SEQ ID NO: 376765

SEQ ID NO: 757908 - RNA, 64 nt, hsa; identical to SEQ ID NO: 376766

SEQ ID NO: 757909 - RNA, 64 nt, hsa; identical to SEQ ID NO: 376767

SEQ ID NO: 757910 - RNA, 64 nt, hsa; identical to SEQ ID NO: 376768

SEQ ID NO: 757911 - RNA, 64 nt, hsa; identical to SEQ ID NO: 376769

SEQ ID NO: 757912 - RNA, 64 nt, hsa; identical to SEQ ID NO: 376770

SEQ ID NO: 757913 - RNA, 64 nt, hsa; identical to SEQ ID NO: 376771

SEQ ID NO: 757914 - RNA, 64 nt, hsa; identical to SEQ ID NO: 376772

SEQ ID NO: 757915 - RNA, 64 nt, hsa; identical to SEQ ID NO: 376773

SEQ ID NO: 757916 - RNA, 64 nt, hsa; identical to SEQ ID NO: 376774

SEQ ID NO: 757917 - RNA, 64 nt, hsa; identical to SEQ ID NO: 376775

SEQ ID NO: 757918 - RNA, 64 nt, hsa; identical to SEQ ID NO: 376776

SEQ ID NO: 757919 - RNA, 64 nt, hsa; identical to SEQ ID NO: 376777

SEQ ID NO: 757920 - RNA, 64 nt, hsa; identical to SEQ ID NO: 376778

SEQ ID NO: 757921 - RNA, 64 nt, hsa; identical to SEQ ID NO: 376779

SEQ ID NO: 757922 - RNA, 64 nt, hsa; identical to SEQ ID NO: 376780

SEQ ID NO: 757923 - RNA, 64 nt, hsa; identical to SEQ ID NO: 376781

SEQ ID NO: 757924 - RNA, 64 nt, hsa; identical to SEQ ID NO: 376782

SEQ ID NO: 757925 - RNA, 64 nt, hsa; identical to SEQ ID NO: 376783

SEQ ID NO: 757926 - RNA, 64 nt, hsa; identical to SEQ ID NO: 376784

SEQ ID NO: 757927 - RNA, 64 nt, hsa; identical to SEQ ID NO: 376785

SEQ ID NO: 757928 - RNA, 64 nt, hsa; identical to SEQ ID NO: 83612

SEQ ID NO: 757929 - RNA, 64 nt, hsa; identical to SEQ ID NO: 83613

SEQ ID NO: 757930 - RNA, 64 nt, hsa; identical to SEQ ID NO: 83614

SEQ ID NO: 757931 - RNA, 64 nt, hsa; identical to SEQ ID NO: 83615

SEQ ID NO: 757932 - RNA, 64 nt, hsa; identical to SEQ ID NO: 83616

SEQ ID NO: 757933 - RNA, 64 nt, hsa; identical to SEQ ID NO: 83617

SEQ ID NO: 757934 - RNA, 64 nt, hsa; identical to SEQ ID NO: 83618

SEQ ID NO: 757935 - RNA, 64 nt, hsa; identical to SEQ ID NO: 83619

SEQ ID NO: 757936 - RNA, 64 nt, hsa; identical to SEQ ID NO: 83620

SEQ ID NO: 757937 - RNA, 64 nt, hsa; identical to SEQ ID NO: 83621

SEQ ID NO: 757938 - RNA, 64 nt, hsa; identical to SEQ ID NO: 83622

SEQ ID NO: 757939 - RNA, 64 nt, hsa; identical to SEQ ID NO: 83623

SEQ ID NO: 757940 - RNA, 64 nt, hsa; identical to SEQ ID NO: 83624

SEQ ID NO: 757941 - RNA, 64 nt, hsa; identical to SEQ ID NO: 83625

SEQ ID NO: 757942 - RNA, 64 nt, hsa; identical to SEQ ID NO: 83626

SEQ ID NO: 757943 - RNA, 64 nt, hsa; identical to SEQ ID NO: 83627

SEQ ID NO: 757944 - RNA, 64 nt, hsa; identical to SEQ ID NO: 83628

SEQ ID NO: 757945 - RNA, 64 nt, hsa; identical to SEQ ID NO: 83629

SEQ ID NO: 757946 - RNA, 64 nt, hsa; identical to SEQ ID NO: 83630

SEQ ID NO: 757947 - RNA, 64 nt, hsa; identical to SEQ ID NO: 83631

SEQ ID NO: 757948 - RNA, 64 nt, hsa; identical to SEQ ID NO: 83632

SEQ ID NO: 757949 - RNA, 60 nt, hsa; identical to SEQ ID NO: 83633

SEQ ID NO: 757950 - RNA, 64 nt, hsa; identical to SEQ ID NO: 83634

SEQ ID NO: 757951 - RNA, 64 nt, hsa; identical to SEQ ID NO: 83635

SEQ ID NO: 757952 - RNA, 64 nt, hsa; identical to SEQ ID NO: 83636

SEQ ID NO: 757953 - RNA, 64 nt, hsa; identical to SEQ ID NO: 83637

SEQ ID NO: 757954 - RNA, 64 nt, hsa; identical to SEQ ID NO: 83638

SEQ ID NO: 757955 - RNA, 64 nt, hsa; identical to SEQ ID NO: 83639

SEQ ID NO: 757956 - RNA, 64 nt, hsa; identical to SEQ ID NO: 83640

SEQ ID NO: 757957 - RNA, 64 nt, hsa; identical to SEQ ID NO: 83641

SEQ ID NO: 757958 - RNA, 64 nt, hsa; identical to SEQ ID NO: 83642

SEQ ID NO: 757959 - RNA, 64 nt, hsa; identical to SEQ ID NO: 83643

SEQ ID NO: 757960 - RNA, 64 nt, hsa; identical to SEQ ID NO: 83644

SEQ ID NO: 757961 - RNA, 64 nt, hsa; identical to SEQ ID NO: 83645

SEQ ID NO: 757962 - RNA, 64 nt, hsa; identical to SEQ ID NO: 83646

SEQ ID NO: 757963 - RNA, 64 nt, hsa; identical to SEQ ID NO: 83647

SEQ ID NO: 757964 - RNA, 64 nt, hsa; identical to SEQ ID NO: 83648

SEQ ID NO: 757965 - RNA, 64 nt, hsa; identical to SEQ ID NO: 83649

SEQ ID NO: 757966 - RNA, 64 nt, hsa; identical to SEQ ID NO: 83650

SEQ ID NO: 757967 - RNA, 54 nt, hsa; identical to SEQ ID NO: 83651

SEQ ID NO: 757968 - RNA, 64 nt, hsa; identical to SEQ ID NO: 83652

SEQ ID NO: 757969 - RNA, 64 nt, hsa; identical to SEQ ID NO: 83653

SEQ ID NO: 757970 - RNA, 64 nt, hsa; identical to SEQ ID NO: 83654

SEQ ID NO: 757971 - RNA, 64 nt, hsa; identical to SEQ ID NO: 83655

SEQ ID NO: 757972 - RNA, 64 nt, hsa; identical to SEQ ID NO: 83656

SEQ ID NO: 757973 - RNA, 64 nt, hsa; identical to SEQ ID NO: 83657

SEQ ID NO: 757974 - RNA, 59 nt, hsa; identical to SEQ ID NO: 83658

SEQ ID NO: 757975 - RNA, 64 nt, hsa; identical to SEQ ID NO: 83659

SEQ ID NO: 757976 - RNA, 64 nt, hsa; identical to SEQ ID NO: 83660

SEQ ID NO: 757977 - RNA, 64 nt, hsa; identical to SEQ ID NO: 83661

SEQ ID NO: 757978 - RNA, 64 nt, hsa; identical to SEQ ID NO: 83662

SEQ ID NO: 757979 - RNA, 64 nt, hsa; identical to SEQ ID NO: 83663

SEQ ID NO: 757980 - RNA, 64 nt, hsa; identical to SEQ ID NO: 83664

SEQ ID NO: 757981 - RNA, 64 nt, hsa; identical to SEQ ID NO: 83665

SEQ ID NO: 757982 - RNA, 64 nt, hsa; identical to SEQ ID NO: 83666

SEQ ID NO: 757983 - RNA, 64 nt, hsa; identical to SEQ ID NO: 83667

SEQ ID NO: 757984 - RNA, 64 nt, hsa; identical to SEQ ID NO: 83668

SEQ ID NO: 757985 - RNA, 64 nt, hsa
ggagccuaaaccaggcugcaucggaggccaggacccggaucauucacugugauacccugcccuc

SEQ ID NO: 757986 - RNA, 64 nt, hsa
accagaggcagaucuggaacucgucaacaacagcccggaucacaugcuguuacuggacugccca

SEQ ID NO: 757987 - RNA, 64 nt, hsa
acuggcauucuuuucuccugugggaguuugccagccggaucacauuacauggcuucaucuaccu

SEQ ID NO: 757988 - RNA, 64 nt, hsa
caagcauugaucuguguacguguccucgaggaucccggaucaucagcacaauugugaaacuugu

SEQ ID NO: 757989 - RNA, 64 nt, hsa
auagcaaugucuggauuggccuccaugacccccaccggaucagucugcugcaucuucuaccucc

SEQ ID NO: 757990 - RNA, 64 nt, hsa
cagucugaaaaccuaagcagacacggagcauuauccggaucagccacacacguguucccuucua

SEQ ID NO: 757991 - RNA, 64 nt, hsa
gagaugcagaaugcauaagaugaacauugcaugaccggaucauuuuagugucuuugcguuaaaa

SEQ ID NO: 757992 - RNA, 57 nt, hsa
cuuuuguggacacuuguugagagagcaccggaucaucucagguaggggagaacugac

SEQ ID NO: 757993 - RNA, 51 nt, hsa
guucuucccugccugcuuagcccggaucaagucacuuagaucgcuccuugg

SEQ ID NO: 757994 - RNA, 64 nt, hsa
ucgagcaaccagucaugaugaaaccaagugguggccggaucaguaugacacccugcugcccccg

SEQ ID NO: 757995 - RNA, 64 nt, hsa
uccacuuuucuauguccuccuuccaccccaagucccggaucacucgcuguuuucuggcuagcuc

SEQ ID NO: 757996 - RNA, 64 nt, hsa
ccugagccccgcccucuuccugacgaaacuggccccggaucagagcaggaccucccuuccgacc

SEQ ID NO: 757997 - RNA, 64 nt, hsa
auucuggaggugcacuuacucuucuacaauguggccggaucauuugucauuccugaauaggucu

SEQ ID NO: 757998 - RNA, 64 nt, hsa
cagcaucacaccagccaugcagccagcagguccuccggaucacugugguuggguggaggucugu

SEQ ID NO: 757999 - RNA, 64 nt, hsa
ggggagacuuuuaggaggccgcagccuuccaucaccggaucaguuuuuccucuuaggaaagcug

SEQ ID NO: 758000 - RNA, 64 nt, hsa
cuccugcugaccccgccacucagcagugcacuccccggaucacagcagggcguuuacauagaaa

SEQ ID NO: 758001 - RNA, 64 nt, hsa
ccgucccaccuccagccgaauagaaggucugcucccggaucacccucagccuuggugcucagug

SEQ ID NO: 758002 - RNA, 64 nt, hsa
ccuguaaacauagauucgcuuuccauguuguuggccggaucaccaucugaagagcagacggaug

SEQ ID NO: 758003 - RNA, 64 nt, hsa
ugcauucucaacacaggacuucccuuaacaguuuccggaucagugaccaccaccacguucaggu

SEQ ID NO: 758004 - RNA, 64 nt, hsa
aguuauaucacaguugagaguuuaaucaaaaugaccggaucagcauauucuuuuuuuagaugag

SEQ ID NO: 758005 - RNA, 64 nt, hsa
ccccaucucuagaaugaggauguuggggaaaaucccggaucaggaucuagaagucuuggguccc

SEQ ID NO: 758006 - RNA, 64 nt, hsa
agaucccagcucuauucuugguauaaaggcuucuccggaucaguacaugcaugucacauuaaca

SEQ ID NO: 758007 - RNA, 64 nt, hsa
cagcuguggccucucgggcucggcagaagggacgccggaucaggggccuggucuccagcaccug

SEQ ID NO: 758008 - RNA, 64 nt, hsa
cccccucccuuuucaaauuccaaugugaccaauuccggaucagggugugaggaggccggggcua

SEQ ID NO: 758009 - RNA, 64 nt, hsa
acccccccagugcaaaccccaaggccaagccaagccggaucagcaccguggucugaugaaugga

SEQ ID NO: 758010 - RNA, 64 nt, hsa; identical to SEQ ID NO: 60066

SEQ ID NO: 758011 - RNA, 64 nt, hsa; identical to SEQ ID NO: 60067

SEQ ID NO: 758012 - RNA, 64 nt, hsa; identical to SEQ ID NO: 60068

SEQ ID NO: 758013 - RNA, 64 nt, hsa; identical to SEQ ID NO: 60069

SEQ ID NO: 758014 - RNA, 64 nt, hsa; identical to SEQ ID NO: 60070

SEQ ID NO: 758015 - RNA, 64 nt, hsa; identical to SEQ ID NO: 60071

SEQ ID NO: 758016 - RNA, 64 nt, hsa; identical to SEQ ID NO: 60072

SEQ ID NO: 758017 - RNA, 64 nt, hsa; identical to SEQ ID NO: 60073

SEQ ID NO: 758018 - RNA, 64 nt, hsa; identical to SEQ ID NO: 60074

SEQ ID NO: 758019 - RNA, 64 nt, hsa; identical to SEQ ID NO: 60075

SEQ ID NO: 758020 - RNA, 64 nt, hsa; identical to SEQ ID NO: 60076

SEQ ID NO: 758021 - RNA, 64 nt, hsa
aucaguuuacuuucaguggauucagaauuguguagcaggauaaccuuguauuuuuccauccgcu

SEQ ID NO: 758022 - RNA, 64 nt, hsa
aucaaacagaguucaaauuccacacagauaagaggcaggauauauaagcgccagugguaguugg

SEQ ID NO: 758023 - RNA, 62 nt, hsa
uuuuccucacaagucaucaugauuuuuuauuuuaaaauaaucuggaaguaaugggaacuuag

SEQ ID NO: 758024 - RNA, 62 nt, hsa
aagaugccucccugauguauagaaucuccuuguaaaauaaauaauugcauuguauaucaguc

SEQ ID NO: 758025 - RNA, 62 nt, hsa
auaugaucagagcuugaacacaggcuuauuuuuaaaauaaaaauauuuuuaacauggguuuc

SEQ ID NO: 758026 - RNA, 62 nt, hsa
uguuauuucuuaaaauucagugagauauaggauaaaauaaugcuuugagaagaauguuuaau

SEQ ID NO: 758027 - RNA, 62 nt, hsa
uaaugcuuugagaagaauguuuaauagaaaauuaaaauaacuuuuucuggccucucuuguuu

SEQ ID NO: 758028 - RNA, 62 nt, hsa
uaacaaacuagguguuauuuauuaacguauuauaaaauaauguuugauccaguaugugcuug

SEQ ID NO: 758029 - RNA, 62 nt, hsa
guugaauuccaauugcuuuuuggccuuuuggcuaaaauaaauguagcaucuaauuuuaucag

SEQ ID NO: 758030 - RNA, 62 nt, hsa
uucagccaucaguucaagagccaaugccuuuuuaaaauaaagcuucuguggucuuguuuuua

SEQ ID NO: 758031 - RNA, 62 nt, hsa
auguuaaauuuaugcauaguaauuuugcacuguaaaauaauucccuucucccauuccuuguc

SEQ ID NO: 758032 - RNA, 62 nt, hsa
aauuuuaauaaauuauauaauuauacauauuguaaaauaaagaccgguauuuuauuuucugc

SEQ ID NO: 758033 - RNA, 62 nt, hsa
ugugucuguuauguucaauaacugagcuaacauaaaauaacucuagguuucuacuugauuuu

SEQ ID NO: 758034 - RNA, 62 nt, hsa
cacuuguuuuugccaaugggagguagacacaauaaaauaaugccaugggagucacacugaaa

SEQ ID NO: 758035 - RNA, 62 nt, hsa
cucuguagcuaacccuuauaaacuaggcucaguaaaauaaagcacucuuauuuuuugaucug

SEQ ID NO: 758036 - RNA, 62 nt, hsa
guguauuuuuucagguuucuggaaauaaauaguaaaauaaauggcacaaauaguuucaauaa

SEQ ID NO: 758037 - RNA, 62 nt, hsa
uaaagaaauuauauuuuguucuauugcuaggguaaaauaaauacauuuguguccaacugaaa

SEQ ID NO: 758038 - RNA, 62 nt, hsa
acauuuguguccaacugaaauauaauugucauuaaaauaauuuuaaagagugaagaaaauau

SEQ ID NO: 758039 - RNA, 62 nt, hsa
gaacaaaaggugccuauucuuuuuuaaaaaaauaaaauaaaacauaaauauuacucuuccau

SEQ ID NO: 758040 - RNA, 62 nt, hsa
aauagccuagggcugaauuuuugucagauaaauaaaauaaaucauucauccuuuuuuuugau

SEQ ID NO: 758041 - RNA, 62 nt, hsa
uaaauguauuuuagacuuccuguagggggcgauaaaauaaaaugcuaaacaacuggguauac

SEQ ID NO: 758042 - RNA, 62 nt, hsa
uauauaauauucaguggcucauuuauaccuaauaaaauaaugguauuuuaaaauaaugcuac

SEQ ID NO: 758043 - RNA, 62 nt, hsa
gcucauuuauaccuaauaaaauaaugguauuuuaaaauaaugcuacuuucaaaguagcauuu

SEQ ID NO: 758044 - RNA, 62 nt, hsa
cuguauauacaauaacauaauuuguacauauguaaaauaaaauuaugccauagcaagauugc

SEQ ID NO: 758045 - RNA, 62 nt, hsa
cuuaaaauagcaacacucuauauuuagauuguuaaaauaacuaguguugcuuggacuauuau

SEQ ID NO: 758046 - RNA, 62 nt, hsa
auccugucucaaaaauuaauuaauuaauuaauuaaaauaaacuagguaaacuuggauaggca

SEQ ID NO: 758047 - RNA, 62 nt, hsa
gugucuucucuuguaaaaaugaaacucaaaaauaaaauaaaugugucaaauuuugaaaaaaa

SEQ ID NO: 758048 - RNA, 62 nt, hsa
gcuucccucaguucaccaaaguuaccaaaauguaaaauaaaauaagacuggcucagguaagu

SEQ ID NO: 758049 - RNA, 62 nt, hsa
ccucaguucaccaaaguuaccaaaauguaaaauaaaauaagacuggcucagguaaguagugc

SEQ ID NO: 758050 - RNA, 62 nt, hsa
uuuuuucauugcucccauaagcaaauuuguuuuaaaauaauuguaaaugagguauauacuua

SEQ ID NO: 758051 - RNA, 62 nt, hsa
uugaaguauauucaaccaaauacuuuaauguauaaaauaaauauuauacaauauacuuguau

SEQ ID NO: 758052 - RNA, 62 nt, hsa
cauuuuuuaaaaaauggacucuugaaaucuguuaaaauaaaauuguacauuuggagauguuu

SEQ ID NO: 758053 - RNA, 62 nt, hsa
caaaaaauaaaauaaaauaaaauaaaauaaaauaaaauaaaauaaaauaaaauaaaauaaaa

SEQ ID NO: 758054 - RNA, 62 nt, hsa
ugucucaaaaaauaaaauaaaauaaaauaaaauaaaauaaaauaaaauaaaauaaaauaaaa

SEQ ID NO: 758055 - RNA, 62 nt, hsa
cacucugucucaaaaaauaaaauaaaauaaaauaaaauaaaauaaaauaaaauaaaauaaaa

SEQ ID NO: 758056 - RNA, 62 nt, hsa
agugacacucugucucaaaaaauaaaauaaaauaaaauaaaauaaaauaaaauaaaauaaaa

SEQ ID NO: 758057 - RNA, 62 nt, hsa
aacagagugacacucugucucaaaaaauaaaauaaaauaaaauaaaauaaaauaaaauaaaa

SEQ ID NO: 758058 - RNA, 62 nt, hsa
ugggcaacagagugacacucugucucaaaaaauaaaauaaaauaaaauaaaauaaaauaaaa

SEQ ID NO: 758059 - RNA, 62 nt, hsa
gccacuguagcgccuuuuuaaaauaaauaaaauaaaauaaagcaccauuuuguuucccuuuc

SEQ ID NO: 758060 - RNA, 62 nt, hsa
guccugccacuguagcgccuuuuuaaaauaaauaaaauaaaauaaagcaccauuuuguuucc

SEQ ID NO: 758061 - RNA, 62 nt, hsa
cccagcagcguccugccacuguagcgccuuuuuaaaauaaauaaaauaaaauaaagcaccau

SEQ ID NO: 758062 - RNA, 62 nt, hsa
guaaaaucuauaucagcaaaagggucuaccuuuaaaauaagcaauaacaaagaagaaaacca

SEQ ID NO: 758063 - RNA, 62 nt, hsa
auuaaggugguggagccacugcaguguuaucuuaaaauaagaauauuuuguugagauauucc

SEQ ID NO: 758064 - RNA, 62 nt, hsa
accauuuugcuaccaguuacauugaacugcuuuaaaauaaauaauaaaauuauuucuaauga

SEQ ID NO: 758065 - RNA, 62 nt, hsa
uauaaaagacuuuuaaugaaauguugccuuuuuaaaauaauuauacuugcacaugaaaauaa

SEQ ID NO: 758066 - RNA, 62 nt, hsa
cuauauaacuaaaaauuuuguuucauaaauuuuaaaauaauuauuuuugacuaugaacauua

SEQ ID NO: 758067 - RNA, 62 nt, hsa
ggguacaagugguccaaacuaagauaagagacuaaaauaaaaugcuaaaucuuaaaagaaac

SEQ ID NO: 758068 - RNA, 62 nt, hsa
gauaaagucgcacauuuuccacaauacauugcuaaaauaaagaggagaaaggcuuaggaagu

SEQ ID NO: 758069 - RNA, 62 nt, hsa
ggauuaaacaaguauaaaauaaaauacauuuauaaaauaaaaaggaaaacagacuuaaauuu

SEQ ID NO: 758070 - RNA, 62 nt, hsa
augugcuaggucuaagauggauuaaacaaguauaaaauaaaauacauuuauaaaauaaaaag

SEQ ID NO: 758071 - RNA, 62 nt, hsa
gcgacagagcaagacccccucucaaaaauaaauaaaauaaaguaaaauaaauauaaauaauu

SEQ ID NO: 758072 - RNA, 62 nt, hsa
aagacccccucucaaaaauaaauaaaauaaaguaaaauaaauauaaauaauuguggccgggu

SEQ ID NO: 758073 - RNA, 62 nt, hsa
ggaaggucugauuugcaggauuuuuagagcauuaaaauaacuaucaggcagaagaaucuuuc

SEQ ID NO: 758074 - RNA, 62 nt, hsa
agucguuugagugcaguaaugaaaucugaaucuaaaauaaaaacaagauuauuuuugucaug

SEQ ID NO: 758075 - RNA, 62 nt, hsa
uuaucucaaguauauaaaguuuugccccaugauaaaauaaguaacauauaaauuaauacaua

SEQ ID NO: 758076 - RNA, 62 nt, hsa
gugaauuuuaaaauguagaagaaagcaaaaaauaaaauaaguccuaaagugaagaagccauc

SEQ ID NO: 758077 - RNA, 62 nt, hsa
ccugauuuucaaaaucugcccucagaugaaaauaaaauaaacgaaacauuuagacaauggcu

SEQ ID NO: 758078 - RNA, 62 nt, hsa
aauuuuaugugacuaugaaacgaauauaagcuuaaaauaagugaaucuaauaaaauggcuau

SEQ ID NO: 758079 - RNA, 62 nt, hsa
gagcgagaccuugucucuaaaaauaauaguaauaaaauaaaaauaacguuuuaugacuauuu

SEQ ID NO: 758080 - RNA, 62 nt, hsa
gcuaaguuaaaauacaguuuaguuauuugcuuuaaaauaaacucuucuuuuuuucuuuaaag

SEQ ID NO: 758081 - RNA, 62 nt, hsa
ccuuugggccuguacaaagaaauucuggauguuaaaauaauauauacucaucacagaaaaau

SEQ ID NO: 758082 - RNA, 62 nt, hsa
ugauaggggaagugggaguugacaggaugguuuaaaauaagacgugaagguuucaguuaccu

SEQ ID NO: 758083 - RNA, 62 nt, hsa
uuuggguuugggguucuugcaguucuaucaucuaaaauaaccuuuggacugcagguaaaaug

SEQ ID NO: 758084 - RNA, 62 nt, hsa
gagcuguauuugcaguuuuguguuggguuuucuaaaauaauauucuuacaaaguauuuuuuu

SEQ ID NO: 758085 - RNA, 62 nt, hsa
uguugcaucucagauaaaccugugacugcugguaaaauaaugucccaagccuuuccuuuuag

SEQ ID NO: 758086 - RNA, 62 nt, hsa
uuauacaauaauuuaaauauuuuuuaaaaccauaaaauaaauuuuuauaaggaauacuguua

SEQ ID NO: 758087 - RNA, 62 nt, hsa
aaccuaaaugaccuaaauaagaacacuguaccuaaaauaaagaggcaacuuuauuaaugccu

SEQ ID NO: 758088 - RNA, 62 nt, hsa
auugcaacccuuuucuuuacccuuuugucuuuuaaaauaaucccagaacaccaaaaauaaaa

SEQ ID NO: 758089 - RNA, 62 nt, hsa
agacucuaucucaaaaauaaaauaaaauaaaauaaaauaauuaauaaaaugguguaguauuu

SEQ ID NO: 758090 - RNA, 62 nt, hsa
gagcaagacucuaucucaaaaauaaaauaaaauaaaauaaaauaauuaauaaaaugguguag

SEQ ID NO: 758091 - RNA, 62 nt, hsa
caacagagcaagacucuaucucaaaaauaaaauaaaauaaaauaaaauaauuaauaaaaugg

SEQ ID NO: 758092 - RNA, 62 nt, hsa
cugagcaacagagcaagacucuaucucaaaaauaaaauaaaauaaaauaaaauaauuaauaa

SEQ ID NO: 758093 - RNA, 62 nt, hsa
ugagauugugguuuuuucuuccuaauguaaaauaaaauaaaacacaucugccuucuugauau

SEQ ID NO: 758094 - RNA, 62 nt, hsa
ugcuuugagauugugguuuuuucuuccuaauguaaaauaaaauaaaacacaucugccuucuu

SEQ ID NO: 758095 - RNA, 62 nt, hsa
uuauuuuaauuguauagaaagaaaaaaaugccuaaaauaagguuuucuugcauaaauacugg

SEQ ID NO: 758096 - RNA, 62 nt, hsa
uuuuaaauggacauugucuguaccagcuucauuaaaauaaacaauauuuguaaaaaucauac

SEQ ID NO: 758097 - RNA, 62 nt, hsa
ucaucuuuucgccuaccugaucuuucuuggaauaaaauaauauauccuuggggucaagaucc

SEQ ID NO: 758098 - RNA, 62 nt, hsa
guaauauauuagaauauacaaauauguguguauaaaauaaacauacacacacacacacaccc

SEQ ID NO: 758099 - RNA, 62 nt, hsa
gcaacugauuuugcaaaaaaaaauuguagcuuuaaaauaacagggucuaaguauuuuaaaug

SEQ ID NO: 758100 - RNA, 62 nt, hsa
gauaagcuaacaauaacagucuguguuuucucuaaaauaaucugaguuuuuuggaacucuuu

SEQ ID NO: 758101 - RNA, 62 nt, hsa
cauauauuuuaugaaucagaauaaccuucaaauaaaauaaaucuaagucgguuaaaauggau

SEQ ID NO: 758102 - RNA, 62 nt, hsa
uaaauauauuuuuauagaaaaacaaaucuacauaaaauaaaucuacuguuuagugagcagua

SEQ ID NO: 758103 - RNA, 62 nt, hsa
uuuaauuuuugggaccucaguuucuuuguaaguaaaauaacaccugcuuguucuucaucccu

SEQ ID NO: 758104 - RNA, 62 nt, hsa
aagcacuuggaaaaugcacuuguccuguuuuguaaaauaaaaagguauuaaauguguauuuc

SEQ ID NO: 758105 - RNA, 62 nt, hsa
gcauaaucaaggcacuguaaaucuuauaauuuuaaaauaaauuacuuaagaacaguugucau

SEQ ID NO: 758106 - RNA, 62 nt, hsa
auaauucuugcauuuuuuccccauaaccugguuaaaauaaauacgccauuggcaauacuuca

SEQ ID NO: 758107 - RNA, 62 nt, hsa
uuaacaauauuaaaugugcaauagaacuuuuauaaaauaauuagaacagagauuuuacaguu

SEQ ID NO: 758108 - RNA, 62 nt, hsa
gaccaaggaaggauuuaaccuggugccaagguuaaaauaacauuucucuacugccuauuguu

SEQ ID NO: 758109 - RNA, 62 nt, hsa
uuuuuaguucuuaaaaauuuauuuuuaaguucuaaaauaaaauaaaaauaaguucuuaaaau

SEQ ID NO: 758110 - RNA, 62 nt, hsa
aguucuuaaaaauuuauuuuuaaguucuaaaauaaaauaaaaauaaguucuuaaaauuuauu

SEQ ID NO: 758111 - RNA, 62 nt, hsa
gaaugaaaugauacgaugucucagauuugcuuuaaaauaauagggagguuggggaagugggu

SEQ ID NO: 758112 - RNA, 62 nt, hsa
uaugaacugugauaaugcagaagguuuccuuuuaaaauaaaguucagucaaaaaagugagau

SEQ ID NO: 758113 - RNA, 62 nt, hsa
uugauuaaaaucuggcaaaguuauauuuacuuuaaaauaaaauaauuuuauugcaauguauu

SEQ ID NO: 758114 - RNA, 62 nt, hsa
uaaaaucuggcaaaguuauauuuacuuuaaaauaaaauaauuuuauugcaauguauuuaucu

SEQ ID NO: 758115 - RNA, 62 nt, hsa
cucugugccucaguuuucccaugcaugaaaaauaaaauaaaauaaaacggggauucuaaugu

SEQ ID NO: 758116 - RNA, 62 nt, hsa
ugccucaguuuucccaugcaugaaaaauaaaauaaaauaaaacggggauucuaauguuugua

SEQ ID NO: 758117 - RNA, 62 nt, hsa
uaacuauauauauugccaucacacacgaacaauaaaauaaaguguucuauuaaccugaucuc

SEQ ID NO: 758118 - RNA, 62 nt, hsa
gcaacauagugagaccuugucucuacaaaaaauaaaauaaaauaaaaaccaaauuagccaga

SEQ ID NO: 758119 - RNA, 62 nt, hsa
auagugagaccuugucucuacaaaaaauaaaauaaaauaaaaaccaaauuagccagacaugg

SEQ ID NO: 758120 - RNA, 62 nt, hsa
cucuuaaaauaaaauccauuuccuauuucucuuaaaauaaaauccauuauucuuaauauggc

SEQ ID NO: 758121 - RNA, 62 nt, hsa
gauuaugcuuaacagcuguuuccuguuucucuuaaaauaaaauccauuuccuauuucucuua

SEQ ID NO: 758122 - RNA, 62 nt, hsa
cagccgccauccuucuccagaauucuuguaaauaaaauaaaucccucuuuguuuaaaccauu

SEQ ID NO: 758123 - RNA, 62 nt, hsa
aggugaggguuacacugaagaugcacaaucccuaaaauaaagaucaccacuuccccaaagaa

SEQ ID NO: 758124 - RNA, 62 nt, hsa
gacaugguaauggcacuccauucgggauguauuaaaauaauuugcuuuucagguauuaauau

SEQ ID NO: 758125 - RNA, 62 nt, hsa
augaagacauuuaacgguugugcuguuuauaguaaaauaaaacucccuaccuugcuucaguu

SEQ ID NO: 758126 - RNA, 62 nt, hsa
auaccuuuguguauagacaagcccaugcccauuaaaauaaaguuauccuguaacauaaauuu

SEQ ID NO: 758127 - RNA, 62 nt, hsa
gcuucuuuggcucuagaaaaauuucaaacaauuaaaauaagaaaaaauuuuaaacugguuuu

SEQ ID NO: 758128 - RNA, 62 nt, hsa
cauucuguuuaaaucccuaagaaugucagaauuaaaauaacagggcuaucccguaauuggaa

SEQ ID NO: 758129 - RNA, 62 nt, hsa
guuuuuauucaaagcagcuguaauuuaguuaauaaaauaauuaugaucuauguuguuugccc

SEQ ID NO: 758130 - RNA, 62 nt, hsa
uuuuuuaaauauauauuuuuaaguaguaugacuaaaauaaagaugaaccagcaaaaggucag

SEQ ID NO: 758131 - RNA, 62 nt, hsa
agaaguuuaugauucaaguggaagaugacuuuuaaaauaauauuuuuuaaauauauauuuuu

SEQ ID NO: 758132 - RNA, 62 nt, hsa
ucuguaauaaaaaacuaaauuaaaccuugcauuaaaauaauaucacaguaucaguggacuaa

SEQ ID NO: 758133 - RNA, 62 nt, hsa
cuaugucucauaaaaauuagaauguacuauuuuaaaauaauauguguaaauugaaauuuuuu

SEQ ID NO: 758134 - RNA, 62 nt, hsa
auaacgucucuuggucacagaugccuuauauauaaaauaaguugccagaucucuaagauugc

SEQ ID NO: 758135 - RNA, 62 nt, hsa
aauaaggcuuuuuagagcagacuuuguuggcauaaaauaaccuggcuucuaucccuaacccu

SEQ ID NO: 758136 - RNA, 62 nt, hsa
agcccucauauaauagguuugaaaguacuccuuaaaauaaaacacuguuucccuuuggaacu

SEQ ID NO: 758137 - RNA, 62 nt, hsa
agugagacccugucacuaacaaaauuaaaaaauaaaauaaauauaaaauauaggcuuuaaaa

SEQ ID NO: 758138 - RNA, 62 nt, hsa
uaaaauaagaauugaaugucaauaugagauauuaaaauaagcacagaaaaucauuggucucu

SEQ ID NO: 758139 - RNA, 62 nt, hsa
acaccauaguuuacaauauuauguuuccuaauuaaaauaagaauugaaugucaauaugagau

SEQ ID NO: 758140 - RNA, 62 nt, hsa
gucuagucuucuuauaauagcagaggucuugguaaaauaacuaccauauauaacguguuauu

SEQ ID NO: 758141 - RNA, 62 nt, hsa
cauauggaaaucuuuuaauaaauauauguaaauaaaauaaaaaauauuugucuccaccuuuu

SEQ ID NO: 758142 - RNA, 62 nt, hsa
uggaagaggcugagguuguggaacacacugaauaaaauaaaggcagugugacuccaaauuca

SEQ ID NO: 758143 - RNA, 62 nt, hsa
ugagccuuuaggugaucuuuaaacuaugguaguaaaauaagccucacucaaacauagcugac

SEQ ID NO: 758144 - RNA, 62 nt, hsa
cuacaaugaacauguuuuauuuuuacuuuuguuaaaauaaauaacauuuaauuugacggaaa

SEQ ID NO: 758145 - RNA, 62 nt, hsa
aaagaaacaagagagaaaaaaaucaaaauaauuaaaauaaauuguuagagaaaaguuacuuu

SEQ ID NO: 758146 - RNA, 62 nt, hsa
uuaaauggaugcauacaguccacaucauacaauaaaauaaaagguaauucagggucccaaag

SEQ ID NO: 758147 - RNA, 62 nt, hsa
agaauaacuauaaaauaugaaagcucuaaauuuaaaauaaauuuagagauagaaucauggua

SEQ ID NO: 758148 - RNA, 62 nt, hsa
aggguuuguuuuguauacaaaugggauuauacuaaaauaaguaaugccuauuuuuaaggaua

SEQ ID NO: 758149 - RNA, 62 nt, hsa
aauuugugaaugaucauuucaaauauauugaauaaaauaagcaaaagcuauuguuauuuacu

SEQ ID NO: 758150 - RNA, 62 nt, hsa
agauaauuuguugggccauauuuuaggacagguaaaauaacaucagguuccaguugcuugaa

SEQ ID NO: 758151 - RNA, 62 nt, hsa
caaggcccugaguuggcaguggcccauaaguguaaaauaaaaguuuacagaaaccuugcaag

SEQ ID NO: 758152 - RNA, 62 nt, hsa
uuuagucaaucguucaucugucauugguacuguaaaauaagcuguggucuauuuccacuguu

SEQ ID NO: 758153 - RNA, 62 nt, hsa
gaaaaugguuucugguaaacugagaaggauauuaaaauaaguggcuuuuuucugggcuacca

SEQ ID NO: 758154 - RNA, 62 nt, hsa
aaauauuuuacaaguuacauauagcaucauucuaaaauaagaauuuuuuuuguuuucugucu

SEQ ID NO: 758155 - RNA, 62 nt, hsa
aaucauguugguuuuaauagugucaauuuuuguaaaauaaaaauuaaacuucaaacucuuua

SEQ ID NO: 758156 - RNA, 62 nt, hsa
acacauuaaccagaaagcuuaaacauuauuauuaaaauaaauuauuucauuugcacacaaug

SEQ ID NO: 758157 - RNA, 62 nt, hsa
aauguuuuuaaauauaaacaaauauucuuuacuaaaauaaaaacucuguguaauuuuuccau

SEQ ID NO: 758158 - RNA, 62 nt, hsa
aauaauaacugacaugccaccgaaguacaaaguaaaauaaauaaauaaauacacauuuuggc

SEQ ID NO: 758159 - RNA, 62 nt, hsa
caaccaacagugaauguggagcugagagacaguaaaauaauaacugacaugccaccgaagua

SEQ ID NO: 758160 - RNA, 62 nt, hsa
cuauaguuuauuuggauuauuuuugaaaaaaguaaaauaacaauacccuuacgaauuuuuug

SEQ ID NO: 758161 - RNA, 62 nt, hsa
auuccauaaaaguaguugggaaaauuauuauguaaaauaauaagacucuuccaaagccuuaa

SEQ ID NO: 758162 - RNA, 62 nt, hsa
agauauguaaguaaagacaagcccuacaauuuuaaaauaacaaagcuuaugucuuaaguugu

SEQ ID NO: 758163 - RNA, 62 nt, hsa
aaaagauuucaguagccuucauugaguuuggguaaaauaaguugcuguucuuuugucuucuu

SEQ ID NO: 758164 - RNA, 62 nt, hsa
agaaguagauuaaaacuagagagcugguuuauuaaaauaagcagauaauuauccaggcuuaa

SEQ ID NO: 758165 - RNA, 62 nt, hsa
uagucaaacaaaauuuacuugguugguccaaauaaaauaaauuguuuuugacuaagugacua

SEQ ID NO: 758166 - RNA, 62 nt, hsa
ugguggaauauauggagagaucuugaaagagguaaaauaaaccuucacugcuccacuccagg

SEQ ID NO: 758167 - RNA, 62 nt, hsa
gguuuagccuuuaaguguauguuuuuauacuuuaaaauaagaaauauaaccuuuuaagcuau

SEQ ID NO: 758168 - RNA, 62 nt, hsa
cauuucuaaugaggauucacauuaauauaauauaaaauaaauaggucaguuacuggucucuu

SEQ ID NO: 758169 - RNA, 62 nt, hsa
uccgaauguuauguuuugcuuuuaucucacaguaaaauaaauauaauuaaugguuugcaugu

SEQ ID NO: 758170 - RNA, 62 nt, hsa
gagauugcaccacugcacuccagcuugggugauaaaauaaaauaaaauagucgugaaucuug

SEQ ID NO: 758171 - RNA, 62 nt, hsa
ugcaccacugcacuccagcuugggugauaaaauaaaauaaaauagucgugaaucuuguucaa

SEQ ID NO: 758172 - RNA, 62 nt, hsa
uuguauauuuauuguauuaacacagagugucauaaaauaaaaugcuguuuacuggauguuug

SEQ ID NO: 758173 - RNA, 62 nt, hsa
acuugguuagcuaaagaagauguaaaaauaucuaaaauaauguucauggugaaucuuauuuu

SEQ ID NO: 758174 - RNA, 62 nt, hsa
uugaugucaauauuaguaguccacuuuaugcuuaaaauaaaaucauaaaaaaucaaguuuua

SEQ ID NO: 758175 - RNA, 62 nt, hsa
cauaaaaaaucaaguuuuaagguuauauuuuuuaaaauaaugaauuuucuaucucuaggcaa

SEQ ID NO: 758176 - RNA, 62 nt, hsa
guuacuucucaguuuccuagaacuucaaguauuaaaauaaccuguugcauguauuaggcaua

SEQ ID NO: 758177 - RNA, 62 nt, hsa
uucuauuuucccuguauugguaucuccuuaaauaaaauaaaauauuccuauuguaagugaua

SEQ ID NO: 758178 - RNA, 62 nt, hsa
gccugggcaauaagagcaaaacuccaucaaaauaaaauaaaauaaaauauaaaauaacuuaa

SEQ ID NO: 758179 - RNA, 62 nt, hsa
ggcaauaagagcaaaacuccaucaaaauaaaauaaaauaaaauauaaaauaacuuaaaaaga

SEQ ID NO: 758180 - RNA, 62 nt, hsa
aaaacuccaucaaaauaaaauaaaauaaaauauaaaauaacuuaaaaagaacuuugaauaaa

SEQ ID NO: 758181 - RNA, 62 nt, hsa
gauccugcuaaauuucaauuaagaggggaccuuaaaauaaggaucaaucucuuauuuaaccc

SEQ ID NO: 758182 - RNA, 62 nt, hsa
ugucuagauuauauagguuuagguugaaguuauaaaauaaaauaaaauucauuuuccacugg

SEQ ID NO: 758183 - RNA, 62 nt, hsa
agauuauauagguuuagguugaaguuauaaaauaaaauaaaauucauuuuccacuggaacuc

SEQ ID NO: 758184 - RNA, 62 nt, hsa
guuaauaauauaacauauaagaauacuuuuauuaaaauaaccaugcaacaauaacacuaucg

SEQ ID NO: 758185 - RNA, 62 nt, hsa
guacguauguuuaucuuacucuuccuauaaacuaaaauaacauuacaguuuccgaauuuagc

SEQ ID NO: 758186 - RNA, 62 nt, hsa
aaaaauuaaaugcauaagcauaagguagaaauuaaaauaacaaaauugucuacagcuucuua

SEQ ID NO: 758187 - RNA, 62 nt, hsa
uacagaguaauuacauggugauuuuugcaauguaaaauaaaguguuucugauuauuuucuau

SEQ ID NO: 758188 - RNA, 62 nt, hsa
gcauaugggagcuuaauauaucauaucuaauuuaaaauaauuucacugaaauaaacuccauu

SEQ ID NO: 758189 - RNA, 62 nt, hsa
cagauuuuacugauauguaaaaauuuugccauuaaaauaaaugauuucucacugagaggaac

SEQ ID NO: 758190 - RNA, 62 nt, hsa
gacaaguuuauaucaaguuaaauguaaauggauaaaauaaaaucauuuucaguaugugauau

SEQ ID NO: 758191 - RNA, 62 nt, hsa
gacccauuuugauaagucuuuauaaggaagaauaaaauaaacguguaagcaaaauuuucuuu

SEQ ID NO: 758192 - RNA, 62 nt, hsa
uuauuuaauucaucuaaugcuacacaaaagcauaaaauaaugauuuuucacucucuuuaaaa

SEQ ID NO: 758193 - RNA, 62 nt, hsa
auguuuguaaaagcucaaacaugacgauuccauaaaauaaacuugagguuaaauaaugggua

SEQ ID NO: 758194 - RNA, 62 nt, hsa
uaagaagcuuucugaaagauugggcuuuaaaauaaaauaauauuuuaauauugaaccauuuu

SEQ ID NO: 758195 - RNA, 62 nt, hsa
uauacuaagaagcuuucugaaagauugggcuuuaaaauaaaauaauauuuuaauauugaacc

SEQ ID NO: 758196 - RNA, 62 nt, hsa
cugccucuccccucccccaguuucuccuccccuaaaauaaaaauaguggucaacuuuaguaa

SEQ ID NO: 758197 - RNA, 62 nt, hsa
ucauuucacucuacugucucaaaauuuuguuuuaaaauaauagaaauguuuugccauuauua

SEQ ID NO: 758198 - RNA, 62 nt, hsa
cuuuugcugucuuucucuaaauaugauuacuuuaaaauaaaaaaguaacaaggugucuuuuc

SEQ ID NO: 758199 - RNA, 62 nt, hsa
ugccguauaggaugucagacaauaccacugguuaaaauaaagccuauuuuucaaauuuagug

SEQ ID NO: 758200 - RNA, 62 nt, hsa
uuaauaguaugaucuuuaaaguuuugacaauauaaaauaaacuugguaacuguuuuacaaau

SEQ ID NO: 758201 - RNA, 62 nt, hsa
uguuggucauaaguuaacuguauuaagaacaguaaaauaaauaaaaaccaauaguacuaauu

SEQ ID NO: 758202 - RNA, 62 nt, hsa
auuuauuguuaauucuuaaaauaguguguaaauaaaauaacaucagugugcuuuaaagaaau

SEQ ID NO: 758203 - RNA, 62 nt, hsa
aaagauaauguacaugcuucaugucaugucuuuaaaauaauuuaaucaacuuuauugucuua

SEQ ID NO: 758204 - RNA, 62 nt, hsa
uauauuaauauaguuuuuuucucccuuuuuaauaaaauaauuacagucaucccucagugucu

SEQ ID NO: 758205 - RNA, 62 nt, hsa
acaaagcaagacugugucucaaaauaaauaaauaaaauaaaauaaaaugacguacagagauu

SEQ ID NO: 758206 - RNA, 62 nt, hsa
gcaagacugugucucaaaauaaauaaauaaaauaaaauaaaaugacguacagagauucuaua

SEQ ID NO: 758207 - RNA, 62 nt, hsa
auauuacauucaugauuauuuuauuuaguaaauaaaauaauagagagcccagaaaucaaccu

SEQ ID NO: 758208 - RNA, 62 nt, hsa
ugaaacugaaccccuacuucuccccauauauguaaaauaauucaauauggaugaaagauuua

SEQ ID NO: 758209 - RNA, 62 nt, hsa
uauuauauagguugaaauuaaagaugaauaaauaaaauaaaaugacacaaggccaaaaacaa

SEQ ID NO: 758210 - RNA, 62 nt, hsa
uugugucuguugcacauuucuugaagcauuuuuaaaauaacauguaaccuguaaccuuguug

SEQ ID NO: 758211 - RNA, 62 nt, hsa
uuuuacuuauagaaacuuaauuauuagacugguaaaauaaagaccaaaauaugcagauuucu

SEQ ID NO: 758212 - RNA, 62 nt, hsa
cuauuuaugucacaucucacauuaaauuauuuuaaaauaagcagugcccuucaaaacagaug

SEQ ID NO: 758213 - RNA, 62 nt, hsa
uuuuugugguucuauuucagguauaggaauuauaaaauaauugguucuuucuaaacacuugu

SEQ ID NO: 758214 - RNA, 62 nt, hsa
aucauuuguauccagauuacuguacuguaggcuaaaauaacacaguauuuacauguuaucuu

SEQ ID NO: 758215 - RNA, 62 nt, hsa
uaguuguggccaccugcugacuauuugugguuuaaaauaaaagguuuacuugucugcagaau

SEQ ID NO: 758216 - RNA, 62 nt, hsa
caugcuuuuuggaaauuuacaucauccucaaguaaaauaaauaucaguuaaauauuggaagc

SEQ ID NO: 758217 - RNA, 62 nt, hsa
uagucuccugcuguuuuaccccuuccauuuuuuaaaauaagaaauuagcagcccucugcaua

SEQ ID NO: 758218 - RNA, 62 nt, hsa
ccugguuaugauacuguggguccauacacaaguaaaauaagauuagacagaagccaguauac

SEQ ID NO: 758219 - RNA, 62 nt, hsa
cucaaguagaagccugaaaauuaaucugcuuuuaaaauaaagagcaguguucuccauucgua

SEQ ID NO: 758220 - RNA, 62 nt, hsa
aucauguuaaccucugcuuuuaucucagauguuaaaauaaaugguuuggugcuuuuuauaaa

SEQ ID NO: 758221 - RNA, 62 nt, hsa
uugaaaagcaauauuguauauuuuuaucuauauaaaauaacuaaaauguaucuaagaauaau

SEQ ID NO: 758222 - RNA, 62 nt, hsa
aauacagauuaccaauuucaagugcugccagcuaaaauaacuguuuuaacggguaucuuuug

SEQ ID NO: 758223 - RNA, 62 nt, hsa
auguuuagcaggcuguaaacuuaagaaaaggguaaaauaaaauuuucuggagaggaacuugg

SEQ ID NO: 758224 - RNA, 62 nt, hsa
aaaggagauuugacacuuaauucccauuuucuuaaaauaacaguuuuguugacuuaaaaaua

SEQ ID NO: 758225 - RNA, 62 nt, hsa
cucauacaccaaaaacacaccaaaaaaaucaauaaaauaagcaaucuucuauucucauuccu

SEQ ID NO: 758226 - RNA, 62 nt, hsa
uuauuuagauggacauugcuuuucaaauaacuuaaaauaacacguuaugugccauguggcua

SEQ ID NO: 758227 - RNA, 62 nt, hsa
uaaaugcuauuuguagucuugauauacagaaauaaaauaauuaggguuggucuuuuuuauuu

SEQ ID NO: 758228 - RNA, 62 nt, hsa
accuuuaaacccauaaauuaauuuuauaucaauaaaauaaaauacuuucucuaguuuuggag

SEQ ID NO: 758229 - RNA, 62 nt, hsa
uacaguuuugugauauaaaauaaagcugaguauaaaauaaaaccaaucaaacacagaauuug

SEQ ID NO: 758230 - RNA, 62 nt, hsa
uaaccuuauaccugaauuacaguuuugugauauaaaauaaagcugaguauaaaauaaaacca

SEQ ID NO: 758231 - RNA, 62 nt, hsa
cagaauaacuucuagguuaugcuauuuuaaaauaaaauaagauuaauaaaaacaaaccuugc

SEQ ID NO: 758232 - RNA, 62 nt, hsa
uauaacagaauaacuucuagguuaugcuauuuuaaaauaaaauaagauuaauaaaaacaaac

SEQ ID NO: 758233 - RNA, 62 nt, hsa
aacacacacacacacacaccccucacauacuauaaaauaaaucuucacugcccuaucaaaau

SEQ ID NO: 758234 - RNA, 62 nt, hsa
auaagaaguccauauacugaagagcguuugauuaaaauaaagugacuauuaaccagaaaaga

SEQ ID NO: 758235 - RNA, 62 nt, hsa
acaauuuuaaauaauucaucuuacaagucagguaaaauaaaaucgauucccagauuccauac

SEQ ID NO: 758236 - RNA, 62 nt, hsa
uaaaauucauaaagucucaucauucuguuggcuaaaauaaugcucuuuacaauaugcuggcu

SEQ ID NO: 758237 - RNA, 62 nt, hsa
ccucaccacugacuauuuuaucaaauuugccuuaaaauaaugaaaaagaaaaguauaguuaa

SEQ ID NO: 758238 - RNA, 62 nt, hsa
aauuaguuaaaauauauuaaaaauauuauuaguaaaauaaaauuucacacaauaaaaaacaa

SEQ ID NO: 758239 - RNA, 62 nt, hsa
auauagaaaaaaaggaggauuuuucugcauuguaaaauaaucaguaugguuuauauguugaa

SEQ ID NO: 758240 - RNA, 62 nt, hsa
auuuaugugcuauggaaggaaaugcuggugacuaaaauaagguuuacucugaaagaggagga

SEQ ID NO: 758241 - RNA, 62 nt, hsa
gcuauaguggaaucuuugguuuugcaucauaguaaaauaaaauaaacccaucacauuuggaa

SEQ ID NO: 758242 - RNA, 62 nt, hsa
aguggaaucuuugguuuugcaucauaguaaaauaaaauaaacccaucacauuuggaacauaa

SEQ ID NO: 758243 - RNA, 62 nt, hsa
guauuucaaagcucuuuuccuaacugguuaaguaaaauaaaaaauugagcuuucuagaauau

SEQ ID NO: 758244 - RNA, 62 nt, hsa
cuagaauauuugccuaauugggaauuaaaaaguaaaauaauaggccaggcaugguggcucau

SEQ ID NO: 758245 - RNA, 62 nt, hsa
aaaugcauauaaaucuugauaaacaaagucuauaaaauaaaacaugggacauuagcuuuggg

SEQ ID NO: 758246 - RNA, 62 nt, hsa
uuaaauucugauauugcacuucuuauuuuauauaaaauaauccuuuaauauccaaaugaauc

SEQ ID NO: 758247 - RNA, 62 nt, hsa
uacuauuuuuauuuuaaaauaaaauuuaccuuuaaaauaauaauaguacuauugcuaguacu

SEQ ID NO: 758248 - RNA, 62 nt, hsa
uaauaguacuauuacuauuacuauuuuuauuuuaaaauaaaauuuaccuuuaaaauaauaau

SEQ ID NO: 758249 - RNA, 62 nt, hsa
auugcaaaaucuccaauccacacauauuguuuuaaaauaagaauguuauccaacuauuaaga

SEQ ID NO: 758250 - RNA, 62 nt, hsa
auuguuugagguuuguugcuagagaacaauaauaaaauaauucuuuuucagaaaauauuuaa

SEQ ID NO: 758251 - RNA, 62 nt, hsa
uuuauaaaauguauaaauuauucagaacuauuuaaaauaaagaggaguguuauugcaugcug

SEQ ID NO: 758252 - RNA, 62 nt, hsa
gguaaacaaagaaaugacaaaaauaaaauaaauaaaauaaaaauggauagguggugacccac

SEQ ID NO: 758253 - RNA, 62 nt, hsa
aaaaggauagguaaacaaagaaaugacaaaaauaaaauaaauaaaauaaaaauggauaggug

SEQ ID NO: 758254 - RNA, 62 nt, hsa
guuguuuugacuaggaauaucaauauuugguauaaaauaacuagaauaguuuauuaccuuuu

SEQ ID NO: 758255 - RNA, 62 nt, hsa
ugaguaucaucuuguccuuuaauccuguacccuaaaauaagaaauacauuuuugacagaggc

SEQ ID NO: 758256 - RNA, 62 nt, hsa
auugcuuacuuuggaauacauuucuccuuugauaaaauaaaugagcuauguauuaacacugc

SEQ ID NO: 758257 - RNA, 62 nt, hsa
caugaaaaaaggacaauuucaaaaaaauaaaauaaaauaaaaauaaauucaccuagucuaag

SEQ ID NO: 758258 - RNA, 62 nt, hsa
uuugacaugaaaaaaggacaauuucaaaaaaauaaaauaaaauaaaaauaaauucaccuagu

SEQ ID NO: 758259 - RNA, 62 nt, hsa
caaauuuuaaaagccacagguguugauuguuauaaaauaacaugcugccauucuugauugcu

SEQ ID NO: 758260 - RNA, 62 nt, hsa
uguugucuucacuuaauccauuuagcacuauuuaaaauaagcacaccaaguuauaugacuaa

SEQ ID NO: 758261 - RNA, 62 nt, hsa
uaugucuauuuuuuucaguuuauuugaaccaauaaaauaauuuuaucucuuucuuucuguug

SEQ ID NO: 758262 - RNA, 62 nt, hsa
aagaacacagcccugcuucugacauaauccaguaaaauaauaauuuuuaagaaauaaauuua

SEQ ID NO: 758263 - RNA, 62 nt, hsa
uggaaccaugcgagugauaccuauuuauaaaauaaaauaaaccaagcacaaguacgaacuua

SEQ ID NO: 758264 - RNA, 62 nt, hsa
gcauuuggaaccaugcgagugauaccuauuuauaaaauaaaauaaaccaagcacaaguacga

SEQ ID NO: 758265 - RNA, 62 nt, hsa
auaguuggaaguaaagcacuccucaguaaaaguaaaauaacagaaauuauuacaaacggucu

SEQ ID NO: 758266 - RNA, 62 nt, hsa
aacuugcgaaucuguuuacccucacuugcaaauaaaauaagugcaaauaaagcaaugauuau

SEQ ID NO: 758267 - RNA, 62 nt, hsa
gcuguagucauacaauuggauaaagcauaauauaaaauaaggcacaauugcuauaugaaacu

SEQ ID NO: 758268 - RNA, 62 nt, hsa
cacuuuucuaaggacugaagauuggcaaaaacuaaaauaaauuaaaacugcuuacaccagaa

SEQ ID NO: 758269 - RNA, 62 nt, hsa
auaaaacuguuauggugucuucaaagacuugauaaaauaacacugagagagaauugguccau

SEQ ID NO: 758270 - RNA, 62 nt, hsa
acaauuguaauuauauugauguucauauuguguaaaauaacucauuuaauaaaauaguacuu

SEQ ID NO: 758271 - RNA, 62 nt, hsa
acuauuuccaaacucauauuacaaaaacaaaauaaaauaauaaaaaaagaaagcaugauauu

SEQ ID NO: 758272 - RNA, 62 nt, hsa
uauaaaagaaacacuuugaagucuauaaaaaauaaaauaauuauaaauaucauuguacauag

SEQ ID NO: 758273 - RNA, 62 nt, hsa
uuaaaagaauguaaaauauaucaucaaguucuuaaaauaauauacaugcauuuaauauuucc

SEQ ID NO: 758274 - RNA, 62 nt, hsa
ucuuuauggauguauuguucacauuauggcuuuaaaauaaugaauauguaaaagugagguag

SEQ ID NO: 758275 - RNA, 62 nt, hsa
ggccaauauaaacauguuugaauugucaaauauaaaauaauguuauugcaauacauacaaaa

SEQ ID NO: 758276 - RNA, 62 nt, hsa
gccaaaauaaaccuguucuuccuuuuuuaaaauaaaauaaguucuuaaaaaauuuauacuua

SEQ ID NO: 758277 - RNA, 62 nt, hsa
uuucugccaaaauaaaccuguucuuccuuuuuuaaaauaaaauaaguucuuaaaaaauuuau

SEQ ID NO: 758278 - RNA, 62 nt, hsa
ggugacagagugagacucugucucaaaaaaaauaaaauaaaaagucaauuuagaaugugaaa

SEQ ID NO: 758279 - RNA, 62 nt, hsa
gaugguuguauaagaacuagcucauguaaaaauaaaauaacauuauuacauugccucaaaaa

SEQ ID NO: 758280 - RNA, 62 nt, hsa
gucauuuaccaggauucccguagggcguuuuguaaaauaaacuauaauauuaaugaaaagua

SEQ ID NO: 758281 - RNA, 62 nt, hsa
acuguaaauacauuuguaccucucuuguauucuaaaauaaaaauuacuuggaacauuuauca

SEQ ID NO: 758282 - RNA, 62 nt, hsa
uuuuacuaguagcuaguguuaggaagugaaccuaaaauaagaaaauauaaugaucuguguuu

SEQ ID NO: 758283 - RNA, 62 nt, hsa
guauagguaaauuuucuuuuucaaauccaauuuaaaauaaccuuuccuuuuaaaugugcugc

SEQ ID NO: 758284 - RNA, 62 nt, hsa
acuuuaaaauuuuuuaaauuauauuaaauuuauaaaauaauuuauaaauucauauauuaaaa

SEQ ID NO: 758285 - RNA, 62 nt, hsa
uggguagauuuucaagagugugaacacaaauuuaaaauaagcuauaaucagcaacaacacaa

SEQ ID NO: 758286 - RNA, 62 nt, hsa
augaugacucaguggugccagaguaaaguuucuaaaauaacauuccucucacuuguacccca

SEQ ID NO: 758287 - RNA, 62 nt, hsa
agauagucucauauuuaggaaaacuuuccaaauaaaauaaauguuauucucugauaaagagc

SEQ ID NO: 758288 - RNA, 62 nt, hsa
acugaccaaaacagaagcaaaaauaagaaaauuaaaauaaucucuaauccuacuaccuagaa

SEQ ID NO: 758289 - RNA, 62 nt, hsa
cagcuguucuuuguagucccuuuuauuaugcauaaaauaaagaaauucuuagauuaaaucag

SEQ ID NO: 758290 - RNA, 62 nt, hsa
cucugauuucaguucacuguucaguuuagcauuaaaauaauaaaauaaucauacaguuccau

SEQ ID NO: 758291 - RNA, 62 nt, hsa
ucaguucacuguucaguuuagcauuaaaauaauaaaauaaucauacaguuccauuugauugu

SEQ ID NO: 758292 - RNA, 62 nt, hsa
acaaaaaugaaaauaauaaacauguuuucguauaaaauaacacaaaaugauauacacugaag

SEQ ID NO: 758293 - RNA, 62 nt, hsa
guaaccagaaauguaaaauuucaaauaacggauaaaauaauguguuauuuuuauagagaaag

SEQ ID NO: 758294 - RNA, 62 nt, hsa
aauguuuucucucuuaaaauauuucuccuguguaaaauaaaucauuguuguuaguaaugguu

SEQ ID NO: 758295 - RNA, 62 nt, hsa
ggcucucuaaagaaaaacucauuguaacuuauuaaaauaauaucuggugcaaaguaucuguu

SEQ ID NO: 758296 - RNA, 62 nt, hsa
uaaucaugugaacauuugaacuaguuauaggauaaaauaaacucagaauaaggauuuaaaau

SEQ ID NO: 758297 - RNA, 62 nt, hsa
uuauaggauaaaauaaacucagaauaaggauuuaaaauaaguaaccaaguggcugugacuuu

SEQ ID NO: 758298 - RNA, 62 nt, hsa
cacuggauuaauaaucuuuugggaggguagaauaaaauaauugauuacuauugcugcauacc

SEQ ID NO: 758299 - RNA, 62 nt, hsa
auggaauuagaugagugcuaugcacuuaauuuuaaaauaaaacuaguuuucaguaaaauggc

SEQ ID NO: 758300 - RNA, 62 nt, hsa
auaauaauaauauuaauaauaauaaagagaaauaaaauaauaaaauaaaaaacaauagcaca

SEQ ID NO: 758301 - RNA, 62 nt, hsa
aauauuaauaauaauaaagagaaauaaaauaauaaaauaaaaaacaauagcacagcccuugu

SEQ ID NO: 758302 - RNA, 62 nt, hsa
uaccuggcacuagcaacauuagaauuuuaaaauaaaauaauugggaaagaaggugggucaug

SEQ ID NO: 758303 - RNA, 62 nt, hsa
uccauuaccuggcacuagcaacauuagaauuuuaaaauaaaauaauugggaaagaagguggg

SEQ ID NO: 758304 - RNA, 62 nt, hsa
uuuauuagagggagcauggccauaaaauaaaauaaaauaaaauuuagauuuaagucgagcuc

SEQ ID NO: 758305 - RNA, 62 nt, hsa
uuagauuuauuagagggagcauggccauaaaauaaaauaaaauaaaauuuagauuuaagucg

SEQ ID NO: 758306 - RNA, 62 nt, hsa
aaaauuuagauuuauuagagggagcauggccauaaaauaaaauaaaauaaaauuuagauuua

SEQ ID NO: 758307 - RNA, 62 nt, hsa
caauuuucuucagaagaauucuaugcuauuauuaaaauaaaauauuuacuguguauugccug

SEQ ID NO: 758308 - RNA, 62 nt, hsa
guaucucuaauuuuauuuucucucuguuacuguaaaauaauagcuauaauguauaacaauuu

SEQ ID NO: 758309 - RNA, 62 nt, hsa
ucaaaaugcacuuuuuaauaaaaacugauacuuaaaauaaauggcuguuauuucuacugugu

SEQ ID NO: 758310 - RNA, 62 nt, hsa
auggucaguaggcaaucuuaaauguuuuuauuuaaaauaaaguauuccuugaaaauauaaau

SEQ ID NO: 758311 - RNA, 62 nt, hsa
aagugcuaagaacuccaugagagaagaugccauaaaauaaacaccucccuaauccuauuauc

SEQ ID NO: 758312 - RNA, 62 nt, hsa
uaucuuugucuauaacugacagauguuuauauuaaaauaaaauauuguauuaaaaauuuaaa

SEQ ID NO: 758313 - RNA, 62 nt, hsa
uguccuuuaagucugcuaggcucucaguacccuaaaauaaacuagauuguguugcuauuuuu

SEQ ID NO: 758314 - RNA, 62 nt, hsa
gguauuaugaugcaucaacuaguucuuccauguaaaauaauuuuagugcaauaugaagacgu

SEQ ID NO: 758315 - RNA, 62 nt, hsa
guuuuuaaaagacugacaguguuuauuauuauuaaaauaaacaggguugguuauauugcaau

SEQ ID NO: 758316 - RNA, 62 nt, hsa
guguuggguagggaggugacgauugccacucauaaaauaaaggauuuuauaaaauaccuucc

SEQ ID NO: 758317 - RNA, 62 nt, hsa
uuuuccauaauauugcaaauaacauaaaaucuuaaaauaauuccaagcugagucuucuagau

SEQ ID NO: 758318 - RNA, 62 nt, hsa
gguaguucuuguuuuuaauaaggggaaaaagauaaaauaaccccuauuuuuccuguuauugu

SEQ ID NO: 758319 - RNA, 62 nt, hsa
uauuaagagaaaaaaaguaauuuaugacuauuuaaaauaaaauuuaaaaguagagugacugu

SEQ ID NO: 758320 - RNA, 62 nt, hsa
uaugaacaugauuuuucuuuauguacaaaaacuaaaauaaagucaauaaagacaauucugac

SEQ ID NO: 758321 - RNA, 62 nt, hsa
uaaaagcuuuggaaacucuguaaaaugaacaauaaaauaaagcauauagcuacuuucaguug

SEQ ID NO: 758322 - RNA, 62 nt, hsa
aguauaacugugcaauucuggaacauauuaauuaaaauaauaugccuuaacauauagugaau

SEQ ID NO: 758323 - RNA, 62 nt, hsa
ugaccuugaaagaugaauuccuucaagaaaaauaaaauaaugcuuaagauaauguguacgaa

SEQ ID NO: 758324 - RNA, 62 nt, hsa
uuggcaguacguucuuugacuuaaggauggcauaaaauaaucauuuuugaaccuguguaaua

SEQ ID NO: 758325 - RNA, 62 nt, hsa
cuacagagagcaagacucugucucaaaaaaaauaaaauaaaauaaauaaaaaaagauauagu

SEQ ID NO: 758326 - RNA, 62 nt, hsa
gagagcaagacucugucucaaaaaaaauaaaauaaaauaaauaaaaaaagauauaguauuaa

SEQ ID NO: 758327 - RNA, 62 nt, hsa
ggugggaaaugggggaucuucaauguuuauuuuaaaauaaaauaaaauaaguucuugacuuu

SEQ ID NO: 758328 - RNA, 62 nt, hsa
gaaaugggggaucuucaauguuuauuuuaaaauaaaauaaaauaaguucuugacuuuucuca

SEQ ID NO: 758329 - RNA, 62 nt, hsa
gggggaucuucaauguuuauuuuaaaauaaaauaaaauaaguucuugacuuuucucaugugu

SEQ ID NO: 758330 - RNA, 62 nt, hsa
gucuuugaauucauuuauuuuaaauaaaugaauaaaauaaaauaaaaaagaauauucagucg

SEQ ID NO: 758331 - RNA, 62 nt, hsa
ugaauucauuuauuuuaaauaaaugaauaaaauaaaauaaaaaagaauauucagucguuggc

SEQ ID NO: 758332 - RNA, 62 nt, hsa
agaaaaaauucugugaauuaagauguaauuuauaaaauaacauuucaauggggguaaacagg

SEQ ID NO: 758333 - RNA, 62 nt, hsa
gagcaagacuccgucucacaaaaaugaauaaauaaaauaaaaauaaaaauguuacuuuuuaa

SEQ ID NO: 758334 - RNA, 62 nt, hsa
augggacaaccacaaggucuggaaacuagguuuaaaauaagugugcacuuggacauaaagac

SEQ ID NO: 758335 - RNA, 62 nt, hsa
auguaacaagccugcacauguaccccagaaucuaaaauaaaaauaaaaagaaaaacaaagaa

SEQ ID NO: 758336 - RNA, 62 nt, hsa
uuuaaaauuugugguaauacccagaauggauguaaaauaacauuuuucaauagauuacuuca

SEQ ID NO: 758337 - RNA, 62 nt, hsa
cuuugagacuaauuuguauugacucgguuuuuuaaaauaacuggcaaaugcuaugcuucuac

SEQ ID NO: 758338 - RNA, 62 nt, hsa
cuuuguguggguugacaccuauuuauaauucuuaaaauaaggguagcucaaaggagccaagu

SEQ ID NO: 758339 - RNA, 62 nt, hsa
gucugaacuuauuuguuuauuuaaaauaauaauaaaauaauuaaaaauuuauuuaucacagu

SEQ ID NO: 758340 - RNA, 62 nt, hsa
cauaaauaacagucugaacuuauuuguuuauuuaaaauaauaauaaaauaauuaaaaauuua

SEQ ID NO: 758341 - RNA, 62 nt, hsa
auguauggauuacuuuuuuuuguaaacaugguuaaaauaaaacuuuugugguucuucugaau

SEQ ID NO: 758342 - RNA, 62 nt, hsa
uagcaguggcuuauuauuuguuuuucauaaauuaaaauaacuuuugauaauguuuacuuuaa

SEQ ID NO: 758343 - RNA, 62 nt, hsa
caucauuuuaugaaaguucagauuuaaaauaauaaaauaaauggacacauucuuuauaaaga

SEQ ID NO: 758344 - RNA, 62 nt, hsa
cagauaaccaucauuuuaugaaaguucagauuuaaaauaauaaaauaaauggacacauucuu

SEQ ID NO: 758345 - RNA, 62 nt, hsa
ggauuuucuauuguuacucugguucuuuguuuuaaaauaaaaauucugaauguacacgacau

SEQ ID NO: 758346 - RNA, 62 nt, hsa
aucucgugggagagccauccaaauaagaaaccuaaaauaauugguucuugguagagauucau

SEQ ID NO: 758347 - RNA, 62 nt, hsa
auaaaauaauauaaaagugauuuauaugaaguuaaaauaaaaaaucaguaugauggaauaaa

SEQ ID NO: 758348 - RNA, 62 nt, hsa
aauuuuggaagcugugaagauaaaauaccaaauaaaauaauauaaaagugauuuauaugaag

SEQ ID NO: 758349 - RNA, 62 nt, hsa
uccuuuugauaaauuuaaaauguuacuuauuuuaaaauaaaugaagugagauggcaugguga

SEQ ID NO: 758350 - RNA, 62 nt, hsa
uuuucaagucugauccauauuuaauaaugcuuuaaaauaaaaauaaaaacaauccuuuugau

SEQ ID NO: 758351 - RNA, 62 nt, hsa
aaugaaacaauguauguuuguuuuaacugaacuaaaauaaauacaugcuuaauccugaguag

SEQ ID NO: 758352 - RNA, 62 nt, hsa
cguugguccauuuuugucuguuucuaugaagauaaaauaauugggggccaucuagaaauaga

SEQ ID NO: 758353 - RNA, 62 nt, hsa
auggaagauaaugcagauauuucugugggaaauaaaauaacuaauuuugagguaccaaauag

SEQ ID NO: 758354 - RNA, 62 nt, hsa
cuuuauucagaagcaguuaucaauaaauuccauaaaauaaugucauugguauuuaaaaauga

SEQ ID NO: 758355 - RNA, 62 nt, hsa
aacuagucuugaaaugccuuuguuuguaaaaauaaaauaaugguacuuucauuuuauaacaa

SEQ ID NO: 758356 - RNA, 62 nt, hsa
ucuuugaaacaauauuauuuugaaauuggcuuuaaaauaaaaccauucagauugaaauucua

SEQ ID NO: 758357 - RNA, 62 nt, hsa
uuccuuuuguauuuguaauguugauuaagauguaaaauaaaaagugugccugauuauuuuug

SEQ ID NO: 758358 - RNA, 62 nt, hsa
caagacucugucucaaaaaaaaaaaauaauaauaaaauaagugagcugaacucaccugaagu

SEQ ID NO: 758359 - RNA, 62 nt, hsa
cgagaaacuaugggaaaaaaaauugcaaaaucuaaaauaaaaaaugcaaaaucuaaaauaaa

SEQ ID NO: 758360 - RNA, 62 nt, hsa
auugcaaaaucuaaaauaaaaaaugcaaaaucuaaaauaaaaaauggaaaggaaacuuugaa

SEQ ID NO: 758361 - RNA, 62 nt, hsa
uaauuucuuuuuuuaaaggaaauuaauauuaguaaaauaaacaccucuuuaauggaagcugc

SEQ ID NO: 758362 - RNA, 62 nt, hsa
uaaaaauugagagguuuccuuuuauuaacuuuuaaaauaaagaaauaaguaguuucauuacg

SEQ ID NO: 758363 - RNA, 62 nt, hsa
guuuguuaggaaauggaauggucucuuugauuuaaaauaaauaaaaauagauuauuacgucu

SEQ ID NO: 758364 - RNA, 62 nt, hsa
uuuuccaaguguagcuaaaauauuuuugcagguaaaauaaagcugauaguacauguguuguu

SEQ ID NO: 758365 - RNA, 62 nt, hsa
uaggacaugagacugguagaagcuggcugagauaaaauaaguauuuauuuaaacuaauguuc

SEQ ID NO: 758366 - RNA, 62 nt, hsa
gugcgaccaaugagacgacuucagcaucuuuuuaaaauaaucuaagcaucauugaagcagua

SEQ ID NO: 758367 - RNA, 62 nt, hsa
aauucauacaacaucagugguuacagcuauacuaaaauaaaacuuuauaugcuaauuaucuu

SEQ ID NO: 758368 - RNA, 62 nt, hsa
cuuuauaugcuaauuaucuucaagggucuuucuaaaauaaaagggguuguuaggcuacugca

SEQ ID NO: 758369 - RNA, 62 nt, hsa
guaaugcaaauuucauaguaauaguaacuuuauaaaauaauauuauaaaauacaggauuuaa

SEQ ID NO: 758370 - RNA, 62 nt, hsa
uauuaaauacuuugugauuuccuauuaagcuuuaaaauaaaucauuguguaaaacaccauca

SEQ ID NO: 758371 - RNA, 62 nt, hsa
gggaggcugacucaaaacuagauagaaaaauauaaaauaaucuucgaccacuugauagcucu

SEQ ID NO: 758372 - RNA, 62 nt, hsa
uacucuuagucucuaaaguugcaguuagaaacuaaaauaauguuuuuuaauauguaauaugc

SEQ ID NO: 758373 - RNA, 62 nt, hsa
uauauauauaauauauacauauauacauaguguaaaauaaaauguuucuuggacaagaaauc

SEQ ID NO: 758374 - RNA, 62 nt, hsa
ugcccuuuuuacccguugacguuuauuuuacguaaaauaaacuguuguuuccaaugcaauca

SEQ ID NO: 758375 - RNA, 62 nt, hsa
uguccuaugacaguucuaugcuaaauguauuuuaaaauaaaagccaaauugaagauuaaaga

SEQ ID NO: 758376 - RNA, 62 nt, hsa
uaugcaauuauauaucugauauauauuauauauaaaauaauauaccuaaguguuuuuuuaaa

SEQ ID NO: 758377 - RNA, 62 nt, hsa
aaagugauaagugauccuuaaaaccagccuucuaaaauaauugcauuccauggguuggguau

SEQ ID NO: 758378 - RNA, 62 nt, hsa
ugugcuuaauguaaagccgcuuuauaaaacuguaaaauaaaguuuuuuucuuaaaaagaaua

SEQ ID NO: 758379 - RNA, 62 nt, hsa
guuuacugcucguaaggaaacauuuuauguauuaaaauaaacuguuccuugauaaaaggcuu

SEQ ID NO: 758380 - RNA, 62 nt, hsa
caguuuguuuuucuuguaaucacuuuucauguuaaaauaaucagcauucaaauuguaugcuu

SEQ ID NO: 758381 - RNA, 62 nt, hsa
uauggguacaacguauguucauuauuuguacauaaaauaaaaccauuuaaaaaguaaugcug

SEQ ID NO: 758382 - RNA, 62 nt, hsa
acuaauggcaaaaauucauggcuagugauguauaaaauaaaauauucuuugcaguaaaauau

SEQ ID NO: 758383 - RNA, 62 nt, hsa
cgcuauuuaaguuaaauuuaaaugaaauaaaauaaaauaaaaucaguuccugagucacacaa

SEQ ID NO: 758384 - RNA, 62 nt, hsa
agugucgcuauuuaaguuaaauuuaaaugaaauaaaauaaaauaaaaucaguuccugaguca

SEQ ID NO: 758385 - RNA, 62 nt, hsa
gggcaauagcaagacuccaucucaaaauaaaauaaaauaaaacuuagagcaaaguuuaaaac

SEQ ID NO: 758386 - RNA, 62 nt, hsa
agcuugggcaauagcaagacuccaucucaaaauaaaauaaaauaaaacuuagagcaaaguuu

SEQ ID NO: 758387 - RNA, 62 nt, hsa
uacaguaaacugaaagaguauauagauagcaauaaaauaacauaaguggacauguuuauagu

SEQ ID NO: 758388 - RNA, 62 nt, hsa
uuucuuuuuacacuaauaacuuuuaugccuuuuaaaauaaauuuauuuucauaaaugguuug

SEQ ID NO: 758389 - RNA, 62 nt, hsa
ggucuuucugggccuuacugugcugguauaauuaaaauaaaauauauuuuguucuauuggua

SEQ ID NO: 758390 - RNA, 62 nt, hsa
agcuuaauucagauaucaguaaaauuaagucauaaaauaaucaugugucaugugacuuuggc

SEQ ID NO: 758391 - RNA, 62 nt, hsa
agaccuuuaccaguaaauuauguuucuguauguaaaauaaccccuuauuagagagacagugu

SEQ ID NO: 758392 - RNA, 62 nt, hsa
cucuauaacugcagaaauuagauaauguuuuauaaaauaaauuugccacauaauaugggaug

SEQ ID NO: 758393 - RNA, 62 nt, hsa
cucuuuuguaaauuacaguuauuucaguauuguaaaauaaauguugacucauuucaugcagg

SEQ ID NO: 758394 - RNA, 62 nt, hsa
caacauagugagauucuguuaaaaaaauaaaauaaaauaaaaccaauuuuuaaaaagagaau

SEQ ID NO: 758395 - RNA, 62 nt, hsa
cugggcaacauagugagauucuguuaaaaaaauaaaauaaaauaaaaccaauuuuuaaaaag

SEQ ID NO: 758396 - RNA, 62 nt, hsa
aaguugcuugagccaagugcuuaaaaaguuaauaaaauaaaaugaucuguaugauaccugca

SEQ ID NO: 758397 - RNA, 62 nt, hsa
aaaacuuuguguuuuggcaaucguuuuauaacuaaaauaaaaugaaagcuaaaucuacacgc

SEQ ID NO: 758398 - RNA, 62 nt, hsa
aaaccacuggaaaacaugcauuuuggaaacuuuaaaauaaaugguuaacauggcauuucuaa

SEQ ID NO: 758399 - RNA, 62 nt, hsa
auaguaaggucaagaagaguaucaaaguauaauaaaauaaaaauuguauacucuccauauau

SEQ ID NO: 758400 - RNA, 62 nt, hsa
uuuauuauugccuguacaaauguauauuaagguaaaauaaaacugacaaaguguuucuaggg

SEQ ID NO: 758401 - RNA, 62 nt, hsa
aauuuuaauccuuuuauuuuaauccuuuuacauaaaauaaucugaacucuuugacaaauugc

SEQ ID NO: 758402 - RNA, 62 nt, hsa
uuuuuuuuauacauaauauauauauauauauauaaaauaacuuauuguaucaguccagguuc

SEQ ID NO: 758403 - RNA, 62 nt, hsa
uccuguugcacugcagcuuguguauagcaugcuaaaauaaauuuuugugugugugugcagaa

SEQ ID NO: 758404 - RNA, 62 nt, hsa
augugguagugagcugaucauccacuuucuucuaaaauaaagagaagaaaauggccaguauu

SEQ ID NO: 758405 - RNA, 62 nt, hsa
uaugcuuucaucuauucagaauuauuucauaguaaaauaaucuacucuuaucacagcugugu

SEQ ID NO: 758406 - RNA, 62 nt, hsa
auucaauaccauacugaagaguuugauacuauuaaaauaagccgcuuuguuuuuuaaauaug

SEQ ID NO: 758407 - RNA, 62 nt, hsa
uaguaaaaaaauaaaauaaauaguacuuaguguaaaauaauuuuauaaaugaucuuuuguac

SEQ ID NO: 758408 - RNA, 62 nt, hsa
guucuaggggguugaacuacauaguaaaaaaauaaaauaaauaguacuuaguguaaaauaau

SEQ ID NO: 758409 - RNA, 62 nt, hsa
auauaaauaugcaccuaggagaaugugcuuuuuaaaauaaugacuacuguuuuuauuaaaac

SEQ ID NO: 758410 - RNA, 62 nt, hsa
uuauacuuaugaaauaaacuuuaccaguugacuaaaauaaugcauguuaacaguuggucugu

SEQ ID NO: 758411 - RNA, 62 nt, hsa
aguuacuuugcuuuuaaagaaacuuggcugcuuaaaauaagcaaaaauuggaugcguaaagu

SEQ ID NO: 758412 - RNA, 62 nt, hsa
uuuuaaucaguuugcuuucuccagagaaauuuuaaaauaauagaagaaauagaaauuuugaa

SEQ ID NO: 758413 - RNA, 62 nt, hsa
uuuuuacugucaucuauuauuuuaacaggaguuaaaauaacuccuguuaaacuuucugacaa

SEQ ID NO: 758414 - RNA, 62 nt, hsa
ugguauuucugucuuauacauaggaaaacauuuaaaauaaauaguuuuuaauuguaggcuca

SEQ ID NO: 758415 - RNA, 62 nt, hsa
cuauguaaaaauaaaauucaaacgcccaggauuaaaauaaaauauaaucugaaaaccucaug

SEQ ID NO: 758416 - RNA, 62 nt, hsa
ggaaaugacugguaauggaaaaaauguuguaauaaaauaaucuaaucaaagaauauuauuaa

SEQ ID NO: 758417 - RNA, 62 nt, hsa
cacuuuugcauuaauuugguuaaaaaauaaaauaaaauaauaauaauguaugaagcucuguu

SEQ ID NO: 758418 - RNA, 62 nt, hsa
ugaagcacuuuugcauuaauuugguuaaaaaauaaaauaaaauaauaauaauguaugaagcu

SEQ ID NO: 758419 - RNA, 62 nt, hsa
gagcaaaauuucaucucaaaaauaagauaaaauaaaauaaacaaauaagacagcacuuuaua

SEQ ID NO: 758420 - RNA, 62 nt, hsa
aacaagagcaaaauuucaucucaaaaauaagauaaaauaaaauaaacaaauaagacagcacu

SEQ ID NO: 758421 - RNA, 62 nt, hsa
uacuuguaauuuuaaauuucagcuucacgauauaaaauaauauaagaacuucugguuuacaa

SEQ ID NO: 758422 - RNA, 62 nt, hsa
ugauuuuuuaaaagcuguuauguugaauucaguaaaauaacauuaccuuauuuuuuuucuua

SEQ ID NO: 758423 - RNA, 62 nt, hsa
cagccaacauugugagacauaaucucuacaaauaaaauaaauuaguuggacaugauggugug

SEQ ID NO: 758424 - RNA, 62 nt, hsa
gagugacagagugagacuuugcaaccaaaaaauaaaauaauaauaauaaugaaauaaauaac

SEQ ID NO: 758425 - RNA, 62 nt, hsa
guuguauuuaacagaaauuguauauuguaauuuaaaauaauuauauaacuguauuugaaaua

SEQ ID NO: 758426 - RNA, 62 nt, hsa
uccuuccugugcuccacguucuucugugugauuaaaauaagaauauuauuuuuggaaauaug

SEQ ID NO: 758427 - RNA, 62 nt, hsa
aacuucagaaucuaaugauaguuuaggguuucuaaaauaagguuuuuuauuguaaaaauuga

SEQ ID NO: 758428 - RNA, 62 nt, hsa
uguggaacauguaaauacugucaaauggaaaauaaaauaaguuauaauuuuugugaauuuca

SEQ ID NO: 758429 - RNA, 62 nt, hsa
gauguaaauguuuuacuuucaacuguguucuuuaaaauaaauccuaccugguuuuuaaauuu

SEQ ID NO: 758430 - RNA, 62 nt, hsa
uuugggaaccaaaguauuuuacuguaaaucuuuaaaauaacagaauucagugcucuuucauu

SEQ ID NO: 758431 - RNA, 62 nt, hsa
ccacucauguaacuauuuuaaauguuaagaaguaaaauaaugaaagauauguuaauuacuuu

SEQ ID NO: 758432 - RNA, 62 nt, hsa
agugacugauuuuaauaaugagauaggucacuuaaaauaacagugccuuugaccuuaaaaca

SEQ ID NO: 758433 - RNA, 62 nt, hsa
agucauuauagcucagaccuaagcuaauuauuuaaaauaaauacauguaaaggccacugcca

SEQ ID NO: 758434 - RNA, 62 nt, hsa
ucuugaggucauauacugaaauaugaauaaauuaaaauaaugaauucagaucuaaucauuuu

SEQ ID NO: 758435 - RNA, 62 nt, hsa
ugggagaggaaaugucagggcaugugcucugauaaaauaaaggcagggaaacaagcugaauu

SEQ ID NO: 758436 - RNA, 62 nt, hsa
ugcugcaugacccuccaaguagaccuguggcuuaaaauaaagaaaaugcagcaaaaagaaug

SEQ ID NO: 758437 - RNA, 62 nt, hsa
uguacacauugauauuuaaugacaaauuuacuuaaaauaaauugaccccuuguucuuacuug

SEQ ID NO: 758438 - RNA, 62 nt, hsa
uuguucaaaucacugcaguagggcucugcaaauaaaauaauguaaccuauuaucauggaucu

SEQ ID NO: 758439 - RNA, 62 nt, hsa
cccagcuuuagucauuugaacaugcuucuaaauaaaauaaaacaaaaccaaaacuauacuuu

SEQ ID NO: 758440 - RNA, 62 nt, hsa
ucaggaggaugcaauuguugaaagcuuugaaauaaaauaacaaugucuucuugaaauuugug

SEQ ID NO: 758441 - RNA, 62 nt, hsa
auguuaacauuucagguuaagccucauacguuuaaaauaaaacucucaguuguuuauuaucc

SEQ ID NO: 758442 - RNA, 64 nt, hsa; identical to SEQ ID NO: 52330

SEQ ID NO: 758443 - RNA, 64 nt, hsa; identical to SEQ ID NO: 52331

SEQ ID NO: 758444 - RNA, 64 nt, hsa; identical to SEQ ID NO: 52332

SEQ ID NO: 758445 - RNA, 64 nt, hsa; identical to SEQ ID NO: 52333

SEQ ID NO: 758446 - RNA, 64 nt, hsa; identical to SEQ ID NO: 52334

SEQ ID NO: 758447 - RNA, 64 nt, hsa; identical to SEQ ID NO: 52335

SEQ ID NO: 758448 - RNA, 64 nt, hsa; identical to SEQ ID NO: 52336

SEQ ID NO: 758449 - RNA, 63 nt, hsa; identical to SEQ ID NO: 52337

SEQ ID NO: 758450 - RNA, 64 nt, hsa; identical to SEQ ID NO: 52338

SEQ ID NO: 758451 - RNA, 64 nt, hsa; identical to SEQ ID NO: 52339

SEQ ID NO: 758452 - RNA, 64 nt, hsa; identical to SEQ ID NO: 52340

SEQ ID NO: 758453 - RNA, 64 nt, hsa; identical to SEQ ID NO: 52341

SEQ ID NO: 758454 - RNA, 64 nt, hsa; identical to SEQ ID NO: 52342

SEQ ID NO: 758455 - RNA, 64 nt, hsa; identical to SEQ ID NO: 52343

SEQ ID NO: 758456 - RNA, 64 nt, hsa; identical to SEQ ID NO: 52344

SEQ ID NO: 758457 - RNA, 64 nt, hsa; identical to SEQ ID NO: 52345

SEQ ID NO: 758458 - RNA, 64 nt, hsa; identical to SEQ ID NO: 52346

SEQ ID NO: 758459 - RNA, 64 nt, hsa; identical to SEQ ID NO: 52347

SEQ ID NO: 758460 - RNA, 64 nt, hsa; identical to SEQ ID NO: 52348

SEQ ID NO: 758461 - RNA, 64 nt, hsa; identical to SEQ ID NO: 52349

SEQ ID NO: 758462 - RNA, 64 nt, hsa; identical to SEQ ID NO: 52350

SEQ ID NO: 758463 - RNA, 64 nt, hsa; identical to SEQ ID NO: 52351

SEQ ID NO: 758464 - RNA, 64 nt, hsa; identical to SEQ ID NO: 52352

SEQ ID NO: 758465 - RNA, 64 nt, hsa; identical to SEQ ID NO: 52353

SEQ ID NO: 758466 - RNA, 64 nt, hsa; identical to SEQ ID NO: 52354

SEQ ID NO: 758467 - RNA, 64 nt, hsa; identical to SEQ ID NO: 52355

SEQ ID NO: 758468 - RNA, 64 nt, hsa; identical to SEQ ID NO: 52356

SEQ ID NO: 758469 - RNA, 64 nt, hsa; identical to SEQ ID NO: 52357

SEQ ID NO: 758470 - RNA, 64 nt, hsa; identical to SEQ ID NO: 52358

SEQ ID NO: 758471 - RNA, 64 nt, hsa; identical to SEQ ID NO: 52359

SEQ ID NO: 758472 - RNA, 64 nt, hsa; identical to SEQ ID NO: 52360

SEQ ID NO: 758473 - RNA, 59 nt, hsa; identical to SEQ ID NO: 52361

SEQ ID NO: 758474 - RNA, 64 nt, hsa; identical to SEQ ID NO: 52362

SEQ ID NO: 758475 - RNA, 64 nt, hsa; identical to SEQ ID NO: 52363

SEQ ID NO: 758476 - RNA, 64 nt, hsa; identical to SEQ ID NO: 52364

SEQ ID NO: 758477 - RNA, 64 nt, hsa; identical to SEQ ID NO: 52365

SEQ ID NO: 758478 - RNA, 64 nt, hsa; identical to SEQ ID NO: 52366

SEQ ID NO: 758479 - RNA, 64 nt, hsa; identical to SEQ ID NO: 52367

SEQ ID NO: 758480 - RNA, 64 nt, hsa; identical to SEQ ID NO: 52368

SEQ ID NO: 758481 - RNA, 64 nt, hsa; identical to SEQ ID NO: 52369

SEQ ID NO: 758482 - RNA, 64 nt, hsa; identical to SEQ ID NO: 52370

SEQ ID NO: 758483 - RNA, 64 nt, hsa; identical to SEQ ID NO: 52371

SEQ ID NO: 758484 - RNA, 64 nt, hsa; identical to SEQ ID NO: 52372

SEQ ID NO: 758485 - RNA, 64 nt, hsa; identical to SEQ ID NO: 52373

SEQ ID NO: 758486 - RNA, 64 nt, hsa; identical to SEQ ID NO: 52374

SEQ ID NO: 758487 - RNA, 64 nt, hsa; identical to SEQ ID NO: 52375

SEQ ID NO: 758488 - RNA, 64 nt, hsa; identical to SEQ ID NO: 249571

SEQ ID NO: 758489 - RNA, 64 nt, hsa; identical to SEQ ID NO: 249572

SEQ ID NO: 758490 - RNA, 64 nt, hsa; identical to SEQ ID NO: 249573

SEQ ID NO: 758491 - RNA, 64 nt, hsa; identical to SEQ ID NO: 249574

SEQ ID NO: 758492 - RNA, 64 nt, hsa; identical to SEQ ID NO: 249575

SEQ ID NO: 758493 - RNA, 64 nt, hsa; identical to SEQ ID NO: 249576

SEQ ID NO: 758494 - RNA, 64 nt, hsa; identical to SEQ ID NO: 249577

SEQ ID NO: 758495 - RNA, 64 nt, hsa; identical to SEQ ID NO: 249578

SEQ ID NO: 758496 - RNA, 64 nt, hsa; identical to SEQ ID NO: 249579

SEQ ID NO: 758497 - RNA, 64 nt, hsa; identical to SEQ ID NO: 249580

SEQ ID NO: 758498 - RNA, 64 nt, hsa; identical to SEQ ID NO: 249581

SEQ ID NO: 758499 - RNA, 64 nt, hsa; identical to SEQ ID NO: 249582

SEQ ID NO: 758500 - RNA, 64 nt, hsa; identical to SEQ ID NO: 249583

SEQ ID NO: 758501 - RNA, 64 nt, hsa; identical to SEQ ID NO: 249584

SEQ ID NO: 758502 - RNA, 64 nt, hsa; identical to SEQ ID NO: 249585

SEQ ID NO: 758503 - RNA, 64 nt, hsa; identical to SEQ ID NO: 249586

SEQ ID NO: 758504 - RNA, 64 nt, hsa; identical to SEQ ID NO: 249587

SEQ ID NO: 758505 - RNA, 64 nt, hsa; identical to SEQ ID NO: 249588

SEQ ID NO: 758506 - RNA, 64 nt, hsa; identical to SEQ ID NO: 249589

SEQ ID NO: 758507 - RNA, 64 nt, hsa; identical to SEQ ID NO: 249590

SEQ ID NO: 758508 - RNA, 64 nt, hsa; identical to SEQ ID NO: 249591

SEQ ID NO: 758509 - RNA, 64 nt, hsa; identical to SEQ ID NO: 249592

SEQ ID NO: 758510 - RNA, 64 nt, hsa; identical to SEQ ID NO: 249593

SEQ ID NO: 758511 - RNA, 64 nt, hsa; identical to SEQ ID NO: 249594

SEQ ID NO: 758512 - RNA, 64 nt, hsa; identical to SEQ ID NO: 249595

SEQ ID NO: 758513 - RNA, 64 nt, hsa; identical to SEQ ID NO: 249596

SEQ ID NO: 758514 - RNA, 64 nt, hsa; identical to SEQ ID NO: 249597

SEQ ID NO: 758515 - RNA, 64 nt, hsa; identical to SEQ ID NO: 249598

SEQ ID NO: 758516 - RNA, 64 nt, hsa; identical to SEQ ID NO: 249599

SEQ ID NO: 758517 - RNA, 64 nt, hsa; identical to SEQ ID NO: 249600

SEQ ID NO: 758518 - RNA, 64 nt, hsa; identical to SEQ ID NO: 249601

SEQ ID NO: 758519 - RNA, 64 nt, hsa; identical to SEQ ID NO: 249602

SEQ ID NO: 758520 - RNA, 64 nt, hsa; identical to SEQ ID NO: 249603

SEQ ID NO: 758521 - RNA, 64 nt, hsa; identical to SEQ ID NO: 249604

SEQ ID NO: 758522 - RNA, 64 nt, hsa; identical to SEQ ID NO: 249605

SEQ ID NO: 758523 - RNA, 64 nt, hsa; identical to SEQ ID NO: 249606

SEQ ID NO: 758524 - RNA, 64 nt, hsa; identical to SEQ ID NO: 217880

SEQ ID NO: 758525 - RNA, 64 nt, hsa; identical to SEQ ID NO: 217881

SEQ ID NO: 758526 - RNA, 64 nt, hsa; identical to SEQ ID NO: 217882

SEQ ID NO: 758527 - RNA, 64 nt, hsa; identical to SEQ ID NO: 217883

SEQ ID NO: 758528 - RNA, 64 nt, hsa; identical to SEQ ID NO: 217884

SEQ ID NO: 758529 - RNA, 64 nt, hsa; identical to SEQ ID NO: 217885

SEQ ID NO: 758530 - RNA, 64 nt, hsa; identical to SEQ ID NO: 217886

SEQ ID NO: 758531 - RNA, 64 nt, hsa; identical to SEQ ID NO: 217887

SEQ ID NO: 758532 - RNA, 64 nt, hsa; identical to SEQ ID NO: 217888

SEQ ID NO: 758533 - RNA, 64 nt, hsa; identical to SEQ ID NO: 217889

SEQ ID NO: 758534 - RNA, 64 nt, hsa; identical to SEQ ID NO: 217890

SEQ ID NO: 758535 - RNA, 64 nt, hsa; identical to SEQ ID NO: 217891

SEQ ID NO: 758536 - RNA, 64 nt, hsa; identical to SEQ ID NO: 217892

SEQ ID NO: 758537 - RNA, 64 nt, hsa; identical to SEQ ID NO: 217893

SEQ ID NO: 758538 - RNA, 64 nt, hsa; identical to SEQ ID NO: 217894

SEQ ID NO: 758539 - RNA, 64 nt, hsa; identical to SEQ ID NO: 217895

SEQ ID NO: 758540 - RNA, 64 nt, hsa; identical to SEQ ID NO: 217896

SEQ ID NO: 758541 - RNA, 64 nt, hsa; identical to SEQ ID NO: 217897

SEQ ID NO: 758542 - RNA, 64 nt, hsa; identical to SEQ ID NO: 217898

SEQ ID NO: 758543 - RNA, 64 nt, hsa; identical to SEQ ID NO: 217899

SEQ ID NO: 758544 - RNA, 64 nt, hsa; identical to SEQ ID NO: 217900

SEQ ID NO: 758545 - RNA, 64 nt, hsa; identical to SEQ ID NO: 217901

SEQ ID NO: 758546 - RNA, 64 nt, hsa; identical to SEQ ID NO: 217902

SEQ ID NO: 758547 - RNA, 64 nt, hsa; identical to SEQ ID NO: 217903

SEQ ID NO: 758548 - RNA, 64 nt, hsa; identical to SEQ ID NO: 217904

SEQ ID NO: 758549 - RNA, 64 nt, hsa; identical to SEQ ID NO: 217905

SEQ ID NO: 758550 - RNA, 64 nt, hsa; identical to SEQ ID NO: 217906

SEQ ID NO: 758551 - RNA, 64 nt, hsa; identical to SEQ ID NO: 217907

SEQ ID NO: 758552 - RNA, 64 nt, hsa; identical to SEQ ID NO: 217908

SEQ ID NO: 758553 - RNA, 64 nt, hsa; identical to SEQ ID NO: 217909

SEQ ID NO: 758554 - RNA, 64 nt, hsa; identical to SEQ ID NO: 217910

SEQ ID NO: 758555 - RNA, 64 nt, hsa; identical to SEQ ID NO: 217911

SEQ ID NO: 758556 - RNA, 64 nt, hsa; identical to SEQ ID NO: 484304

SEQ ID NO: 758557 - RNA, 64 nt, hsa; identical to SEQ ID NO: 484305

SEQ ID NO: 758558 - RNA, 64 nt, hsa; identical to SEQ ID NO: 484306

SEQ ID NO: 758559 - RNA, 64 nt, hsa; identical to SEQ ID NO: 484307

SEQ ID NO: 758560 - RNA, 64 nt, hsa; identical to SEQ ID NO: 484308

SEQ ID NO: 758561 - RNA, 64 nt, hsa; identical to SEQ ID NO: 484309

SEQ ID NO: 758562 - RNA, 64 nt, hsa; identical to SEQ ID NO: 484310

SEQ ID NO: 758563 - RNA, 64 nt, hsa; identical to SEQ ID NO: 484311

SEQ ID NO: 758564 - RNA, 64 nt, hsa; identical to SEQ ID NO: 484312

SEQ ID NO: 758565 - RNA, 64 nt, hsa; identical to SEQ ID NO: 484313

SEQ ID NO: 758566 - RNA, 64 nt, hsa; identical to SEQ ID NO: 484314

SEQ ID NO: 758567 - RNA, 64 nt, hsa; identical to SEQ ID NO: 484315

SEQ ID NO: 758568 - RNA, 64 nt, hsa; identical to SEQ ID NO: 73453

SEQ ID NO: 758569 - RNA, 64 nt, hsa; identical to SEQ ID NO: 73454

SEQ ID NO: 758570 - RNA, 64 nt, hsa; identical to SEQ ID NO: 73455

SEQ ID NO: 758571 - RNA, 64 nt, hsa; identical to SEQ ID NO: 73456

SEQ ID NO: 758572 - RNA, 64 nt, hsa; identical to SEQ ID NO: 73457

SEQ ID NO: 758573 - RNA, 64 nt, hsa; identical to SEQ ID NO: 73458

SEQ ID NO: 758574 - RNA, 64 nt, hsa; identical to SEQ ID NO: 73459

SEQ ID NO: 758575 - RNA, 64 nt, hsa; identical to SEQ ID NO: 73460

SEQ ID NO: 758576 - RNA, 64 nt, hsa; identical to SEQ ID NO: 73461

SEQ ID NO: 758577 - RNA, 64 nt, hsa; identical to SEQ ID NO: 73462

SEQ ID NO: 758578 - RNA, 64 nt, hsa; identical to SEQ ID NO: 73463

SEQ ID NO: 758579 - RNA, 64 nt, hsa; identical to SEQ ID NO: 73464

SEQ ID NO: 758580 - RNA, 64 nt, hsa; identical to SEQ ID NO: 73465

SEQ ID NO: 758581 - RNA, 64 nt, hsa; identical to SEQ ID NO: 73466

SEQ ID NO: 758582 - RNA, 64 nt, hsa; identical to SEQ ID NO: 73467

SEQ ID NO: 758583 - RNA, 64 nt, hsa; identical to SEQ ID NO: 73468

SEQ ID NO: 758584 - RNA, 64 nt, hsa; identical to SEQ ID NO: 73469

SEQ ID NO: 758585 - RNA, 64 nt, hsa; identical to SEQ ID NO: 73470

SEQ ID NO: 758586 - RNA, 64 nt, hsa; identical to SEQ ID NO: 73471

SEQ ID NO: 758587 - RNA, 64 nt, hsa; identical to SEQ ID NO: 73472

SEQ ID NO: 758588 - RNA, 64 nt, hsa; identical to SEQ ID NO: 73473

SEQ ID NO: 758589 - RNA, 64 nt, hsa; identical to SEQ ID NO: 73474

SEQ ID NO: 758590 - RNA, 64 nt, hsa; identical to SEQ ID NO: 73475

SEQ ID NO: 758591 - RNA, 64 nt, hsa; identical to SEQ ID NO: 73476

SEQ ID NO: 758592 - RNA, 64 nt, hsa; identical to SEQ ID NO: 73477

SEQ ID NO: 758593 - RNA, 64 nt, hsa; identical to SEQ ID NO: 73478

SEQ ID NO: 758594 - RNA, 64 nt, hsa; identical to SEQ ID NO: 73479

SEQ ID NO: 758595 - RNA, 64 nt, hsa; identical to SEQ ID NO: 73480

SEQ ID NO: 758596 - RNA, 64 nt, hsa; identical to SEQ ID NO: 73481

SEQ ID NO: 758597 - RNA, 64 nt, hsa; identical to SEQ ID NO: 73482

SEQ ID NO: 758598 - RNA, 64 nt, hsa; identical to SEQ ID NO: 73483

SEQ ID NO: 758599 - RNA, 64 nt, hsa; identical to SEQ ID NO: 73484

SEQ ID NO: 758600 - RNA, 64 nt, hsa; identical to SEQ ID NO: 73485

SEQ ID NO: 758601 - RNA, 64 nt, hsa; identical to SEQ ID NO: 73486

SEQ ID NO: 758602 - RNA, 64 nt, hsa; identical to SEQ ID NO: 73487

SEQ ID NO: 758603 - RNA, 64 nt, hsa; identical to SEQ ID NO: 73488

SEQ ID NO: 758604 - RNA, 64 nt, hsa; identical to SEQ ID NO: 73489

SEQ ID NO: 758605 - RNA, 64 nt, hsa; identical to SEQ ID NO: 73490

SEQ ID NO: 758606 - RNA, 64 nt, hsa; identical to SEQ ID NO: 73491

SEQ ID NO: 758607 - RNA, 64 nt, hsa; identical to SEQ ID NO: 73492

SEQ ID NO: 758608 - RNA, 64 nt, hsa; identical to SEQ ID NO: 73493

SEQ ID NO: 758609 - RNA, 64 nt, hsa; identical to SEQ ID NO: 73494

SEQ ID NO: 758610 - RNA, 64 nt, hsa; identical to SEQ ID NO: 73495

SEQ ID NO: 758611 - RNA, 64 nt, hsa; identical to SEQ ID NO: 73496

SEQ ID NO: 758612 - RNA, 64 nt, hsa; identical to SEQ ID NO: 73497

SEQ ID NO: 758613 - RNA, 64 nt, hsa; identical to SEQ ID NO: 73498

SEQ ID NO: 758614 - RNA, 64 nt, hsa; identical to SEQ ID NO: 73499

SEQ ID NO: 758615 - RNA, 64 nt, hsa; identical to SEQ ID NO: 73500

SEQ ID NO: 758616 - RNA, 64 nt, hsa; identical to SEQ ID NO: 73501

SEQ ID NO: 758617 - RNA, 64 nt, hsa; identical to SEQ ID NO: 73502

SEQ ID NO: 758618 - RNA, 64 nt, hsa; identical to SEQ ID NO: 73503

SEQ ID NO: 758619 - RNA, 64 nt, hsa; identical to SEQ ID NO: 73504

SEQ ID NO: 758620 - RNA, 64 nt, hsa; identical to SEQ ID NO: 73505

SEQ ID NO: 758621 - RNA, 64 nt, hsa; identical to SEQ ID NO: 73506

SEQ ID NO: 758622 - RNA, 64 nt, hsa; identical to SEQ ID NO: 73507

SEQ ID NO: 758623 - RNA, 64 nt, hsa; identical to SEQ ID NO: 73508

SEQ ID NO: 758624 - RNA, 64 nt, hsa; identical to SEQ ID NO: 73509

SEQ ID NO: 758625 - RNA, 64 nt, hsa; identical to SEQ ID NO: 73510

SEQ ID NO: 758626 - RNA, 64 nt, hsa; identical to SEQ ID NO: 73511

SEQ ID NO: 758627 - RNA, 64 nt, hsa; identical to SEQ ID NO: 73512

SEQ ID NO: 758628 - RNA, 64 nt, hsa; identical to SEQ ID NO: 73513

SEQ ID NO: 758629 - RNA, 62 nt, hsa
ccugauuucccguaaaggugugcagccugagagacgggaagaggaggccucuggaccugcug

SEQ ID NO: 758630 - RNA, 62 nt, hsa
cucgcggcagcugucauuuccaugugcacugggacgggaagucaaacgaggaauuuaaaaaa

SEQ ID NO: 758631 - RNA, 62 nt, hsa
uguaaucccagcacuuugagaggccgaggugagacgggaagauggcuugaacucaggaguuc

SEQ ID NO: 758632 - RNA, 62 nt, hsa
gucuucaugauuaaauucagccuaaacuuuuugacgggaacacugcagagacaaugcuguga

SEQ ID NO: 758633 - RNA, 62 nt, hsa
aaacucaaccacucuggaauuuacccauagaagacgggaagaaagagguaugaagaugggcu

SEQ ID NO: 758634 - RNA, 62 nt, hsa
uuuauagcuuuaauuuguguuauuucuuuauugacgggaagagguacaucuuuuuuuccuua

SEQ ID NO: 758635 - RNA, 62 nt, hsa
ggacauuuccagaacuaccaugagaugguuuagacgggaauucaugcaaaugaggggucaaa

SEQ ID NO: 758636 - RNA, 62 nt, hsa
caucagcgaguuauuguaacuggucaccacuggacgggaaggagaacagaggagagggaaag

SEQ ID NO: 758637 - RNA, 62 nt, hsa
gaugcugguggcuggugagaccccgcacugcagacgggaaugccuaggucccuucccgaccc

SEQ ID NO: 758638 - RNA, 62 nt, hsa
uuccuuucggacccuuuuagcugggguugggggacgggaagagccgugcccccuugggcgca

SEQ ID NO: 758639 - RNA, 62 nt, hsa
ugguuugaaguuuaguuuaauguuagugcagugacgggaaauacacauuaugcuaauguuga

SEQ ID NO: 758640 - RNA, 62 nt, hsa
ggugggaaagauuacuuuuucuuuauguguuugacgggaaacaaaacuagguaaaaucuaca

SEQ ID NO: 758641 - RNA, 62 nt, hsa
uucgucaaccgguacuuuuaagguuaggaugggacgggaaaagugaagcaggauauuagcuc

SEQ ID NO: 758642 - RNA, 62 nt, hsa
agucccgccacuuccagauagacuacgaugaggacgggaacugcucuuuaauuauuagugau

SEQ ID NO: 758643 - RNA, 62 nt, hsa
ggcugggggacuuccugcuggucggggcccaagacgggaacuccuccuuccugcuucagggc

SEQ ID NO: 758644 - RNA, 62 nt, hsa
uaugaagcucuugauaggacuuccuuaagcaugacgggaaaaccaaacacguucccuaauca

SEQ ID NO: 758645 - RNA, 62 nt, hsa
ccuugagacuuggagcccugccucugagccuggacgggaaguguggccuguugugugugugc

SEQ ID NO: 758646 - RNA, 62 nt, hsa
ggaccucaaacuuccuuuccacaagauucugugacgggaaacaaugggggaguauuuccgaa

SEQ ID NO: 758647 - RNA, 62 nt, hsa
accuggcuccaagaagcaucgcuggucuuggggacgggaagggaacccucuuccaggagcuc

SEQ ID NO: 758648 - RNA, 62 nt, hsa
cuaacuuaagccaugacuuuuagauaugagaugacgggaagcaggacgaaauaucggcgugu

SEQ ID NO: 758649 - RNA, 62 nt, hsa
ucuagaacaguacaagguuaaagaggugaggugacgggaaauacacagcauagcuuugaaau

SEQ ID NO: 758650 - RNA, 62 nt, hsa
ucagagccaggcgugucuugacgguaucugcugacgggaacaagucauucugaaaggucccu

SEQ ID NO: 758651 - RNA, 62 nt, hsa
ccaggguggggcccaccaagauuccugaucaugacgggaagcugagugacccugaggccuua

SEQ ID NO: 758652 - RNA, 59 nt, hsa
gugauucuccugucuucuaaauaaucagugacgggaagauggaagggcaugaugaacuc

SEQ ID NO: 758653 - RNA, 62 nt, hsa
cacauccagcauugucccagugcuuugaguuggacgggaaugggacucugcagccaaggcag

SEQ ID NO: 758654 - RNA, 62 nt, hsa
cccgccgccccacaccucuccccuuugggcuggacgggaacacacguguguggcucaggagg

SEQ ID NO: 758655 - RNA, 62 nt, hsa
uuuuuugucucugaaauuugcacuacgucuuggacgggaaucacuggggcagagggcgccug

SEQ ID NO: 758656 - RNA, 62 nt, hsa
uuacuccugaaccgugucccugagacuucccagacgggaaucagaaccacuucuccugucca

SEQ ID NO: 758657 - RNA, 62 nt, hsa
ccucucggugauauuuuuucuacgccaaaacagacgggaaagggaacaaaauaaagugaaau

SEQ ID NO: 758658 - RNA, 62 nt, hsa
agaaggaggcaucguccaguaagaccgucccggacgggaagcuggugaaagguaugcugcca

SEQ ID NO: 758659 - RNA, 62 nt, hsa
cauaggugggaagauacucaucuuucuacauagacgggaacacgguguagcauggagauuaa

SEQ ID NO: 758660 - RNA, 62 nt, hsa
gaaacaagauaaucaguuacugagugaagaaagacgggaaugaugucccauacuucccagcu

SEQ ID NO: 758661 - RNA, 62 nt, hsa
cacccuaaucuauuuagauucauacuuauugagacgggaaaaacucgcuguaaaauaaugcc

SEQ ID NO: 758662 - RNA, 62 nt, hsa
gcacuuugguucaaggggcccaccaagucuuggacgggaaggcgcuacugguuuuauugccc

SEQ ID NO: 758663 - RNA, 62 nt, hsa
augacagccugggguccuugugccaccugguggacgggaaaggcagggcggcugcaguuuca

SEQ ID NO: 758664 - RNA, 62 nt, hsa
agguggaguugaagagcuuccuggaggugcuggacgggaagauugacgaccugcaugacuuc

SEQ ID NO: 758665 - RNA, 62 nt, hsa
cauccacccaggucccgagcccucacacccuggacgggaagggacagcugcauuccagagca

SEQ ID NO: 758666 - RNA, 61 nt, hsa
gagcagaucaucggaggugaggacagcgucugacgggaagccugaucuggaaccuucccaa

SEQ ID NO: 758667 - RNA, 62 nt, hsa
cagucucccgcuguggggcaggaacaggaagugacgggaaccuugaggaggaaacgccugug

SEQ ID NO: 758668 - RNA, 62 nt, hsa
gaaugaacuucugagggccaaaaaaugugacugacgggaacaauucuuaaacugauuaacua

SEQ ID NO: 758669 - RNA, 62 nt, hsa
acccauccaggcccuggccagugugggaccgggacgggaaggaagaaggaggcuaggagcag

SEQ ID NO: 758670 - RNA, 62 nt, hsa
acauuuauccaagaccugaaagaugggcaaaagacgggaagcaagaugugaaagaagagcag

SEQ ID NO: 758671 - RNA, 62 nt, hsa
gcacugaucuggagaucugcagaucuggaggagacgggaaggagucgauucuuaaauaagga

SEQ ID NO: 758672 - RNA, 62 nt, hsa
cccggggcggguggagggugggauuuaagggagacgggaacacauggggcagguccuggaac

SEQ ID NO: 758673 - RNA, 60 nt, hsa
ugaaaaagaaacccuucugauuaccuucaugacgggaaccuaaggacgaagccuacaggg

SEQ ID NO: 758674 - RNA, 62 nt, hsa
gaaacagcaagggcggggucaagacacgggaugacgggaagcaggaagcggggcagcagcac

SEQ ID NO: 758675 - RNA, 62 nt, hsa
gaucccccugccugucgcaccccuuggcgggagacgggaaggcagcgggcugcguacgaugg

SEQ ID NO: 758676 - RNA, 61 nt, hsa
uccgagucacgcucaauugaacccugccagagacgggaagaggggggcugucggcugcugc

SEQ ID NO: 758677 - RNA, 62 nt, hsa
uuuauuuaaaauguucauuaauaaaguuguuggacgggaagcaaaaaaaaaaaguuguuuaa

SEQ ID NO: 758678 - RNA, 62 nt, hsa
uuaagagcccuagggcaggcuggaccugucaagacgggaaggggaagaguagagagggaggg

SEQ ID NO: 758679 - RNA, 62 nt, hsa
gcagccagggccauguugcacaaggccugagagacgggaaagggcccgaucgcucuuucccg

SEQ ID NO: 758680 - RNA, 62 nt, hsa
agcuucagugugcaggcucugaggcugcccaggacgggaaaguccaaggaaggggccuggug

SEQ ID NO: 758681 - RNA, 62 nt, hsa
cagcucuuuccagagaauucucaguuuuaugagacgggaaacuuuauuucacgagaaagccu

SEQ ID NO: 758682 - RNA, 62 nt, hsa
cguuuagcauggcaugagggccacauuccauggacgggaagaccccuuccucuucagagguc

SEQ ID NO: 758683 - RNA, 62 nt, hsa
auacucgggaggcuaaggcaggagaaucgcuugacgggaagcggagguugcagugagccgag

SEQ ID NO: 758684 - RNA, 62 nt, hsa
aggggucagcaaacuuuuucuguaaagggccagacgggaaauauuuugggcuuugcaggcca

SEQ ID NO: 758685 - RNA, 64 nt, hsa; identical to SEQ ID NO: 179925

SEQ ID NO: 758686 - RNA, 64 nt, hsa; identical to SEQ ID NO: 179926

SEQ ID NO: 758687 - RNA, 64 nt, hsa; identical to SEQ ID NO: 179927

SEQ ID NO: 758688 - RNA, 64 nt, hsa; identical to SEQ ID NO: 179928

SEQ ID NO: 758689 - RNA, 64 nt, hsa; identical to SEQ ID NO: 179929

SEQ ID NO: 758690 - RNA, 64 nt, hsa; identical to SEQ ID NO: 179930

SEQ ID NO: 758691 - RNA, 64 nt, hsa; identical to SEQ ID NO: 179931

SEQ ID NO: 758692 - RNA, 64 nt, hsa; identical to SEQ ID NO: 179932

SEQ ID NO: 758693 - RNA, 64 nt, hsa; identical to SEQ ID NO: 179933

SEQ ID NO: 758694 - RNA, 64 nt, hsa; identical to SEQ ID NO: 179934

SEQ ID NO: 758695 - RNA, 64 nt, hsa; identical to SEQ ID NO: 179935

SEQ ID NO: 758696 - RNA, 64 nt, hsa; identical to SEQ ID NO: 179936

SEQ ID NO: 758697 - RNA, 64 nt, hsa; identical to SEQ ID NO: 179937

SEQ ID NO: 758698 - RNA, 64 nt, hsa; identical to SEQ ID NO: 179938

SEQ ID NO: 758699 - RNA, 64 nt, hsa; identical to SEQ ID NO: 179939

SEQ ID NO: 758700 - RNA, 64 nt, hsa; identical to SEQ ID NO: 179940

SEQ ID NO: 758701 - RNA, 64 nt, hsa; identical to SEQ ID NO: 179941

SEQ ID NO: 758702 - RNA, 64 nt, hsa; identical to SEQ ID NO: 179942

SEQ ID NO: 758703 - RNA, 64 nt, hsa; identical to SEQ ID NO: 179943

SEQ ID NO: 758704 - RNA, 64 nt, hsa; identical to SEQ ID NO: 439551

SEQ ID NO: 758705 - RNA, 64 nt, hsa; identical to SEQ ID NO: 439552

SEQ ID NO: 758706 - RNA, 64 nt, hsa; identical to SEQ ID NO: 439553

SEQ ID NO: 758707 - RNA, 64 nt, hsa; identical to SEQ ID NO: 439554

SEQ ID NO: 758708 - RNA, 64 nt, hsa; identical to SEQ ID NO: 439555

SEQ ID NO: 758709 - RNA, 64 nt, hsa; identical to SEQ ID NO: 439556

SEQ ID NO: 758710 - RNA, 64 nt, hsa; identical to SEQ ID NO: 439557

SEQ ID NO: 758711 - RNA, 64 nt, hsa; identical to SEQ ID NO: 439558

SEQ ID NO: 758712 - RNA, 64 nt, hsa; identical to SEQ ID NO: 439559

SEQ ID NO: 758713 - RNA, 64 nt, hsa; identical to SEQ ID NO: 439560

SEQ ID NO: 758714 - RNA, 64 nt, hsa; identical to SEQ ID NO: 439561

SEQ ID NO: 758715 - RNA, 64 nt, hsa; identical to SEQ ID NO: 439562

SEQ ID NO: 758716 - RNA, 64 nt, hsa; identical to SEQ ID NO: 439563

SEQ ID NO: 758717 - RNA, 64 nt, hsa; identical to SEQ ID NO: 439564

SEQ ID NO: 758718 - RNA, 64 nt, hsa; identical to SEQ ID NO: 439565

SEQ ID NO: 758719 - RNA, 64 nt, hsa; identical to SEQ ID NO: 439566

SEQ ID NO: 758720 - RNA, 64 nt, hsa; identical to SEQ ID NO: 439567

SEQ ID NO: 758721 - RNA, 64 nt, hsa; identical to SEQ ID NO: 439568

SEQ ID NO: 758722 - RNA, 64 nt, hsa; identical to SEQ ID NO: 439569

SEQ ID NO: 758723 - RNA, 64 nt, hsa; identical to SEQ ID NO: 439570

SEQ ID NO: 758724 - RNA, 64 nt, hsa; identical to SEQ ID NO: 439571

SEQ ID NO: 758725 - RNA, 64 nt, hsa; identical to SEQ ID NO: 439572

SEQ ID NO: 758726 - RNA, 64 nt, hsa; identical to SEQ ID NO: 439573

SEQ ID NO: 758727 - RNA, 64 nt, hsa; identical to SEQ ID NO: 439574

SEQ ID NO: 758728 - RNA, 64 nt, hsa; identical to SEQ ID NO: 439575

SEQ ID NO: 758729 - RNA, 64 nt, hsa; identical to SEQ ID NO: 439576

SEQ ID NO: 758730 - RNA, 64 nt, hsa; identical to SEQ ID NO: 439577

SEQ ID NO: 758731 - RNA, 64 nt, hsa; identical to SEQ ID NO: 439578

SEQ ID NO: 758732 - RNA, 64 nt, hsa; identical to SEQ ID NO: 439579

SEQ ID NO: 758733 - RNA, 64 nt, hsa; identical to SEQ ID NO: 439580

SEQ ID NO: 758734 - RNA, 64 nt, hsa; identical to SEQ ID NO: 439581

SEQ ID NO: 758735 - RNA, 64 nt, hsa; identical to SEQ ID NO: 439582

SEQ ID NO: 758736 - RNA, 64 nt, hsa; identical to SEQ ID NO: 439583

SEQ ID NO: 758737 - RNA, 64 nt, hsa; identical to SEQ ID NO: 439584

SEQ ID NO: 758738 - RNA, 64 nt, hsa; identical to SEQ ID NO: 439585

SEQ ID NO: 758739 - RNA, 64 nt, hsa; identical to SEQ ID NO: 439586

SEQ ID NO: 758740 - RNA, 64 nt, hsa; identical to SEQ ID NO: 439587

SEQ ID NO: 758741 - RNA, 64 nt, hsa; identical to SEQ ID NO: 439588

SEQ ID NO: 758742 - RNA, 64 nt, hsa; identical to SEQ ID NO: 439589

SEQ ID NO: 758743 - RNA, 64 nt, hsa; identical to SEQ ID NO: 439590

SEQ ID NO: 758744 - RNA, 64 nt, hsa; identical to SEQ ID NO: 439591

SEQ ID NO: 758745 - RNA, 64 nt, hsa; identical to SEQ ID NO: 439592

SEQ ID NO: 758746 - RNA, 64 nt, hsa; identical to SEQ ID NO: 439593

SEQ ID NO: 758747 - RNA, 64 nt, hsa; identical to SEQ ID NO: 439594

SEQ ID NO: 758748 - RNA, 64 nt, hsa; identical to SEQ ID NO: 439595

SEQ ID NO: 758749 - RNA, 64 nt, hsa; identical to SEQ ID NO: 439596

SEQ ID NO: 758750 - RNA, 64 nt, hsa; identical to SEQ ID NO: 439597

SEQ ID NO: 758751 - RNA, 64 nt, hsa; identical to SEQ ID NO: 439598

SEQ ID NO: 758752 - RNA, 53 nt, hsa; identical to SEQ ID NO: 126861

SEQ ID NO: 758753 - RNA, 64 nt, hsa; identical to SEQ ID NO: 126862

SEQ ID NO: 758754 - RNA, 64 nt, hsa; identical to SEQ ID NO: 126863

SEQ ID NO: 758755 - RNA, 64 nt, hsa; identical to SEQ ID NO: 126864

SEQ ID NO: 758756 - RNA, 64 nt, hsa; identical to SEQ ID NO: 126865

SEQ ID NO: 758757 - RNA, 64 nt, hsa; identical to SEQ ID NO: 126866

SEQ ID NO: 758758 - RNA, 64 nt, hsa; identical to SEQ ID NO: 126867

SEQ ID NO: 758759 - RNA, 64 nt, hsa; identical to SEQ ID NO: 126868

SEQ ID NO: 758760 - RNA, 64 nt, hsa; identical to SEQ ID NO: 126869

SEQ ID NO: 758761 - RNA, 64 nt, hsa; identical to SEQ ID NO: 126870

SEQ ID NO: 758762 - RNA, 64 nt, hsa; identical to SEQ ID NO: 126871

SEQ ID NO: 758763 - RNA, 64 nt, hsa; identical to SEQ ID NO: 126872

SEQ ID NO: 758764 - RNA, 64 nt, hsa; identical to SEQ ID NO: 126873

SEQ ID NO: 758765 - RNA, 64 nt, hsa; identical to SEQ ID NO: 126874

SEQ ID NO: 758766 - RNA, 64 nt, hsa; identical to SEQ ID NO: 126875

SEQ ID NO: 758767 - RNA, 64 nt, hsa; identical to SEQ ID NO: 126876

SEQ ID NO: 758768 - RNA, 64 nt, hsa; identical to SEQ ID NO: 126877

SEQ ID NO: 758769 - RNA, 53 nt, hsa; identical to SEQ ID NO: 126878

SEQ ID NO: 758770 - RNA, 64 nt, hsa; identical to SEQ ID NO: 126879

SEQ ID NO: 758771 - RNA, 64 nt, hsa; identical to SEQ ID NO: 126880

SEQ ID NO: 758772 - RNA, 64 nt, hsa; identical to SEQ ID NO: 126881

SEQ ID NO: 758773 - RNA, 64 nt, hsa; identical to SEQ ID NO: 126882

SEQ ID NO: 758774 - RNA, 64 nt, hsa; identical to SEQ ID NO: 126883

SEQ ID NO: 758775 - RNA, 64 nt, hsa; identical to SEQ ID NO: 126884

SEQ ID NO: 758776 - RNA, 64 nt, hsa; identical to SEQ ID NO: 126885

SEQ ID NO: 758777 - RNA, 64 nt, hsa; identical to SEQ ID NO: 126886

SEQ ID NO: 758778 - RNA, 64 nt, hsa; identical to SEQ ID NO: 126887

SEQ ID NO: 758779 - RNA, 64 nt, hsa; identical to SEQ ID NO: 126888

SEQ ID NO: 758780 - RNA, 64 nt, hsa; identical to SEQ ID NO: 126889

SEQ ID NO: 758781 - RNA, 64 nt, hsa; identical to SEQ ID NO: 126890

SEQ ID NO: 758782 - RNA, 64 nt, hsa; identical to SEQ ID NO: 126891

SEQ ID NO: 758783 - RNA, 64 nt, hsa; identical to SEQ ID NO: 126892

SEQ ID NO: 758784 - RNA, 64 nt, hsa; identical to SEQ ID NO: 126893

SEQ ID NO: 758785 - RNA, 64 nt, hsa; identical to SEQ ID NO: 126894

SEQ ID NO: 758786 - RNA, 64 nt, hsa; identical to SEQ ID NO: 126895

SEQ ID NO: 758787 - RNA, 64 nt, hsa; identical to SEQ ID NO: 126896

SEQ ID NO: 758788 - RNA, 64 nt, hsa; identical to SEQ ID NO: 126897

SEQ ID NO: 758789 - RNA, 64 nt, hsa; identical to SEQ ID NO: 126898

SEQ ID NO: 758790 - RNA, 64 nt, hsa; identical to SEQ ID NO: 126899

SEQ ID NO: 758791 - RNA, 64 nt, hsa; identical to SEQ ID NO: 126900

SEQ ID NO: 758792 - RNA, 64 nt, hsa; identical to SEQ ID NO: 126901

SEQ ID NO: 758793 - RNA, 64 nt, hsa; identical to SEQ ID NO: 126902

SEQ ID NO: 758794 - RNA, 64 nt, hsa; identical to SEQ ID NO: 126903

SEQ ID NO: 758795 - RNA, 64 nt, hsa; identical to SEQ ID NO: 126904

SEQ ID NO: 758796 - RNA, 64 nt, hsa; identical to SEQ ID NO: 126905

SEQ ID NO: 758797 - RNA, 64 nt, hsa; identical to SEQ ID NO: 126906

SEQ ID NO: 758798 - RNA, 64 nt, hsa; identical to SEQ ID NO: 126907

SEQ ID NO: 758799 - RNA, 64 nt, hsa; identical to SEQ ID NO: 126908

SEQ ID NO: 758800 - RNA, 64 nt, hsa; identical to SEQ ID NO: 126909

SEQ ID NO: 758801 - RNA, 64 nt, hsa; identical to SEQ ID NO: 126910

SEQ ID NO: 758802 - RNA, 64 nt, hsa; identical to SEQ ID NO: 126911

SEQ ID NO: 758803 - RNA, 64 nt, hsa; identical to SEQ ID NO: 126912

SEQ ID NO: 758804 - RNA, 64 nt, hsa; identical to SEQ ID NO: 126913

SEQ ID NO: 758805 - RNA, 64 nt, hsa; identical to SEQ ID NO: 126914

SEQ ID NO: 758806 - RNA, 64 nt, hsa; identical to SEQ ID NO: 126915

SEQ ID NO: 758807 - RNA, 64 nt, hsa; identical to SEQ ID NO: 126916

SEQ ID NO: 758808 - RNA, 64 nt, hsa; identical to SEQ ID NO: 126917

SEQ ID NO: 758809 - RNA, 64 nt, hsa; identical to SEQ ID NO: 126918

SEQ ID NO: 758810 - RNA, 64 nt, hsa; identical to SEQ ID NO: 126919

SEQ ID NO: 758811 - RNA, 64 nt, hsa; identical to SEQ ID NO: 126920

SEQ ID NO: 758812 - RNA, 64 nt, hsa; identical to SEQ ID NO: 126921

SEQ ID NO: 758813 - RNA, 64 nt, hsa; identical to SEQ ID NO: 126922

SEQ ID NO: 758814 - RNA, 64 nt, hsa; identical to SEQ ID NO: 126923

SEQ ID NO: 758815 - RNA, 64 nt, hsa; identical to SEQ ID NO: 126924

SEQ ID NO: 758816 - RNA, 64 nt, hsa; identical to SEQ ID NO: 126925

SEQ ID NO: 758817 - RNA, 64 nt, hsa; identical to SEQ ID NO: 126926

SEQ ID NO: 758818 - RNA, 64 nt, hsa; identical to SEQ ID NO: 126927

SEQ ID NO: 758819 - RNA, 64 nt, hsa; identical to SEQ ID NO: 126928

SEQ ID NO: 758820 - RNA, 64 nt, hsa; identical to SEQ ID NO: 126929

SEQ ID NO: 758821 - RNA, 64 nt, hsa; identical to SEQ ID NO: 126930

SEQ ID NO: 758822 - RNA, 64 nt, hsa; identical to SEQ ID NO: 126931

SEQ ID NO: 758823 - RNA, 64 nt, hsa; identical to SEQ ID NO: 126932

SEQ ID NO: 758824 - RNA, 64 nt, hsa; identical to SEQ ID NO: 126933

SEQ ID NO: 758825 - RNA, 64 nt, hsa; identical to SEQ ID NO: 126934

SEQ ID NO: 758826 - RNA, 64 nt, hsa; identical to SEQ ID NO: 126935

SEQ ID NO: 758827 - RNA, 64 nt, hsa; identical to SEQ ID NO: 126936

SEQ ID NO: 758828 - RNA, 64 nt, hsa; identical to SEQ ID NO: 126937

SEQ ID NO: 758829 - RNA, 64 nt, hsa; identical to SEQ ID NO: 126938

SEQ ID NO: 758830 - RNA, 64 nt, hsa; identical to SEQ ID NO: 126939

SEQ ID NO: 758831 - RNA, 55 nt, hsa; identical to SEQ ID NO: 126940

SEQ ID NO: 758832 - RNA, 64 nt, hsa; identical to SEQ ID NO: 126941

SEQ ID NO: 758833 - RNA, 64 nt, hsa; identical to SEQ ID NO: 126942

SEQ ID NO: 758834 - RNA, 64 nt, hsa; identical to SEQ ID NO: 126943

SEQ ID NO: 758835 - RNA, 64 nt, hsa; identical to SEQ ID NO: 126944

SEQ ID NO: 758836 - RNA, 64 nt, hsa; identical to SEQ ID NO: 126945

SEQ ID NO: 758837 - RNA, 64 nt, hsa; identical to SEQ ID NO: 126946

SEQ ID NO: 758838 - RNA, 64 nt, hsa; identical to SEQ ID NO: 126947

SEQ ID NO: 758839 - RNA, 64 nt, hsa; identical to SEQ ID NO: 126948

SEQ ID NO: 758840 - RNA, 64 nt, hsa; identical to SEQ ID NO: 126949

SEQ ID NO: 758841 - RNA, 64 nt, hsa; identical to SEQ ID NO: 126950

SEQ ID NO: 758842 - RNA, 64 nt, hsa; identical to SEQ ID NO: 126951

SEQ ID NO: 758843 - RNA, 64 nt, hsa; identical to SEQ ID NO: 126952

SEQ ID NO: 758844 - RNA, 64 nt, hsa; identical to SEQ ID NO: 126953

SEQ ID NO: 758845 - RNA, 64 nt, hsa; identical to SEQ ID NO: 126954

SEQ ID NO: 758846 - RNA, 64 nt, hsa; identical to SEQ ID NO: 126955

SEQ ID NO: 758847 - RNA, 64 nt, hsa; identical to SEQ ID NO: 126956

SEQ ID NO: 758848 - RNA, 64 nt, hsa; identical to SEQ ID NO: 126957

SEQ ID NO: 758849 - RNA, 64 nt, hsa; identical to SEQ ID NO: 126958

SEQ ID NO: 758850 - RNA, 64 nt, hsa; identical to SEQ ID NO: 126959

SEQ ID NO: 758851 - RNA, 64 nt, hsa; identical to SEQ ID NO: 126960

SEQ ID NO: 758852 - RNA, 64 nt, hsa; identical to SEQ ID NO: 126961

SEQ ID NO: 758853 - RNA, 64 nt, hsa; identical to SEQ ID NO: 126962

SEQ ID NO: 758854 - RNA, 64 nt, hsa; identical to SEQ ID NO: 126963

SEQ ID NO: 758855 - RNA, 64 nt, hsa; identical to SEQ ID NO: 126964

SEQ ID NO: 758856 - RNA, 64 nt, hsa; identical to SEQ ID NO: 126965

SEQ ID NO: 758857 - RNA, 64 nt, hsa; identical to SEQ ID NO: 126966

SEQ ID NO: 758858 - RNA, 64 nt, hsa; identical to SEQ ID NO: 126967

SEQ ID NO: 758859 - RNA, 64 nt, hsa; identical to SEQ ID NO: 126968

SEQ ID NO: 758860 - RNA, 64 nt, hsa; identical to SEQ ID NO: 126969

SEQ ID NO: 758861 - RNA, 64 nt, hsa; identical to SEQ ID NO: 126970

SEQ ID NO: 758862 - RNA, 64 nt, hsa; identical to SEQ ID NO: 126971

SEQ ID NO: 758863 - RNA, 64 nt, hsa; identical to SEQ ID NO: 126972

SEQ ID NO: 758864 - RNA, 64 nt, hsa; identical to SEQ ID NO: 126973

SEQ ID NO: 758865 - RNA, 64 nt, hsa; identical to SEQ ID NO: 126974

SEQ ID NO: 758866 - RNA, 64 nt, hsa; identical to SEQ ID NO: 126975

SEQ ID NO: 758867 - RNA, 64 nt, hsa; identical to SEQ ID NO: 126976

SEQ ID NO: 758868 - RNA, 64 nt, hsa; identical to SEQ ID NO: 126977

SEQ ID NO: 758869 - RNA, 64 nt, hsa; identical to SEQ ID NO: 126978

SEQ ID NO: 758870 - RNA, 64 nt, hsa; identical to SEQ ID NO: 126979

SEQ ID NO: 758871 - RNA, 64 nt, hsa; identical to SEQ ID NO: 126980

SEQ ID NO: 758872 - RNA, 64 nt, hsa; identical to SEQ ID NO: 126981

SEQ ID NO: 758873 - RNA, 64 nt, hsa; identical to SEQ ID NO: 126982

SEQ ID NO: 758874 - RNA, 64 nt, hsa; identical to SEQ ID NO: 126983

SEQ ID NO: 758875 - RNA, 64 nt, hsa; identical to SEQ ID NO: 126984

SEQ ID NO: 758876 - RNA, 64 nt, hsa; identical to SEQ ID NO: 126985

SEQ ID NO: 758877 - RNA, 64 nt, hsa; identical to SEQ ID NO: 126986

SEQ ID NO: 758878 - RNA, 64 nt, hsa; identical to SEQ ID NO: 126987

SEQ ID NO: 758879 - RNA, 60 nt, hsa; identical to SEQ ID NO: 126988

SEQ ID NO: 758880 - RNA, 64 nt, hsa; identical to SEQ ID NO: 126989

SEQ ID NO: 758881 - RNA, 64 nt, hsa; identical to SEQ ID NO: 126990

SEQ ID NO: 758882 - RNA, 64 nt, hsa; identical to SEQ ID NO: 126991

SEQ ID NO: 758883 - RNA, 64 nt, hsa; identical to SEQ ID NO: 126992

SEQ ID NO: 758884 - RNA, 64 nt, hsa; identical to SEQ ID NO: 126993

SEQ ID NO: 758885 - RNA, 64 nt, hsa; identical to SEQ ID NO: 126994

SEQ ID NO: 758886 - RNA, 64 nt, hsa; identical to SEQ ID NO: 84437

SEQ ID NO: 758887 - RNA, 64 nt, hsa; identical to SEQ ID NO: 84438

SEQ ID NO: 758888 - RNA, 64 nt, hsa; identical to SEQ ID NO: 209951

SEQ ID NO: 758889 - RNA, 64 nt, hsa; identical to SEQ ID NO: 209952

SEQ ID NO: 758890 - RNA, 64 nt, hsa; identical to SEQ ID NO: 209953

SEQ ID NO: 758891 - RNA, 64 nt, hsa; identical to SEQ ID NO: 209954

SEQ ID NO: 758892 - RNA, 64 nt, hsa; identical to SEQ ID NO: 209955

SEQ ID NO: 758893 - RNA, 64 nt, hsa; identical to SEQ ID NO: 209956

SEQ ID NO: 758894 - RNA, 64 nt, hsa; identical to SEQ ID NO: 209957

SEQ ID NO: 758895 - RNA, 64 nt, hsa; identical to SEQ ID NO: 209958

SEQ ID NO: 758896 - RNA, 64 nt, hsa; identical to SEQ ID NO: 209959

SEQ ID NO: 758897 - RNA, 64 nt, hsa; identical to SEQ ID NO: 209960

SEQ ID NO: 758898 - RNA, 64 nt, hsa; identical to SEQ ID NO: 209961

SEQ ID NO: 758899 - RNA, 64 nt, hsa; identical to SEQ ID NO: 209962

SEQ ID NO: 758900 - RNA, 64 nt, hsa; identical to SEQ ID NO: 209963

SEQ ID NO: 758901 - RNA, 64 nt, hsa; identical to SEQ ID NO: 209964

SEQ ID NO: 758902 - RNA, 64 nt, hsa; identical to SEQ ID NO: 209965

SEQ ID NO: 758903 - RNA, 64 nt, hsa; identical to SEQ ID NO: 209966

SEQ ID NO: 758904 - RNA, 64 nt, hsa; identical to SEQ ID NO: 209967

SEQ ID NO: 758905 - RNA, 64 nt, hsa; identical to SEQ ID NO: 209968

SEQ ID NO: 758906 - RNA, 64 nt, hsa; identical to SEQ ID NO: 209969

SEQ ID NO: 758907 - RNA, 64 nt, hsa; identical to SEQ ID NO: 209970

SEQ ID NO: 758908 - RNA, 64 nt, hsa; identical to SEQ ID NO: 209971

SEQ ID NO: 758909 - RNA, 64 nt, hsa; identical to SEQ ID NO: 209972

SEQ ID NO: 758910 - RNA, 64 nt, hsa; identical to SEQ ID NO: 209973

SEQ ID NO: 758911 - RNA, 64 nt, hsa; identical to SEQ ID NO: 209974

SEQ ID NO: 758912 - RNA, 64 nt, hsa; identical to SEQ ID NO: 209975

SEQ ID NO: 758913 - RNA, 64 nt, hsa; identical to SEQ ID NO: 209976

SEQ ID NO: 758914 - RNA, 64 nt, hsa; identical to SEQ ID NO: 209977

SEQ ID NO: 758915 - RNA, 64 nt, hsa; identical to SEQ ID NO: 209978

SEQ ID NO: 758916 - RNA, 64 nt, hsa; identical to SEQ ID NO: 209979

SEQ ID NO: 758917 - RNA, 64 nt, hsa; identical to SEQ ID NO: 209980

SEQ ID NO: 758918 - RNA, 64 nt, hsa; identical to SEQ ID NO: 209981

SEQ ID NO: 758919 - RNA, 64 nt, hsa; identical to SEQ ID NO: 209982

SEQ ID NO: 758920 - RNA, 64 nt, hsa; identical to SEQ ID NO: 209983

SEQ ID NO: 758921 - RNA, 64 nt, hsa; identical to SEQ ID NO: 209984

SEQ ID NO: 758922 - RNA, 64 nt, hsa; identical to SEQ ID NO: 209985

SEQ ID NO: 758923 - RNA, 64 nt, hsa; identical to SEQ ID NO: 209986

SEQ ID NO: 758924 - RNA, 64 nt, hsa; identical to SEQ ID NO: 209987

SEQ ID NO: 758925 - RNA, 64 nt, hsa; identical to SEQ ID NO: 209988

SEQ ID NO: 758926 - RNA, 64 nt, hsa; identical to SEQ ID NO: 209989

SEQ ID NO: 758927 - RNA, 64 nt, hsa; identical to SEQ ID NO: 209990

SEQ ID NO: 758928 - RNA, 64 nt, hsa; identical to SEQ ID NO: 209991

SEQ ID NO: 758929 - RNA, 64 nt, hsa; identical to SEQ ID NO: 209992

SEQ ID NO: 758930 - RNA, 64 nt, hsa; identical to SEQ ID NO: 209993

SEQ ID NO: 758931 - RNA, 64 nt, hsa; identical to SEQ ID NO: 209994

SEQ ID NO: 758932 - RNA, 64 nt, hsa; identical to SEQ ID NO: 209995

SEQ ID NO: 758933 - RNA, 64 nt, hsa; identical to SEQ ID NO: 209996

SEQ ID NO: 758934 - RNA, 64 nt, hsa; identical to SEQ ID NO: 209997

SEQ ID NO: 758935 - RNA, 64 nt, hsa; identical to SEQ ID NO: 209998

SEQ ID NO: 758936 - RNA, 64 nt, hsa; identical to SEQ ID NO: 209999

SEQ ID NO: 758937 - RNA, 64 nt, hsa; identical to SEQ ID NO: 210000

SEQ ID NO: 758938 - RNA, 64 nt, hsa; identical to SEQ ID NO: 210001

SEQ ID NO: 758939 - RNA, 64 nt, hsa; identical to SEQ ID NO: 210002

SEQ ID NO: 758940 - RNA, 64 nt, hsa; identical to SEQ ID NO: 210003

SEQ ID NO: 758941 - RNA, 64 nt, hsa; identical to SEQ ID NO: 210004

SEQ ID NO: 758942 - RNA, 64 nt, hsa; identical to SEQ ID NO: 210005

SEQ ID NO: 758943 - RNA, 64 nt, hsa; identical to SEQ ID NO: 210006

SEQ ID NO: 758944 - RNA, 64 nt, hsa; identical to SEQ ID NO: 210007

SEQ ID NO: 758945 - RNA, 64 nt, hsa; identical to SEQ ID NO: 210008

SEQ ID NO: 758946 - RNA, 64 nt, hsa; identical to SEQ ID NO: 210009

SEQ ID NO: 758947 - RNA, 64 nt, hsa; identical to SEQ ID NO: 210010

SEQ ID NO: 758948 - RNA, 64 nt, hsa; identical to SEQ ID NO: 210011

SEQ ID NO: 758949 - RNA, 64 nt, hsa; identical to SEQ ID NO: 210012

SEQ ID NO: 758950 - RNA, 64 nt, hsa; identical to SEQ ID NO: 210013

SEQ ID NO: 758951 - RNA, 64 nt, hsa; identical to SEQ ID NO: 210014

SEQ ID NO: 758952 - RNA, 64 nt, hsa; identical to SEQ ID NO: 210015

SEQ ID NO: 758953 - RNA, 64 nt, hsa; identical to SEQ ID NO: 210016

SEQ ID NO: 758954 - RNA, 64 nt, hsa; identical to SEQ ID NO: 210017

SEQ ID NO: 758955 - RNA, 64 nt, hsa; identical to SEQ ID NO: 210018

SEQ ID NO: 758956 - RNA, 64 nt, hsa; identical to SEQ ID NO: 210019

SEQ ID NO: 758957 - RNA, 64 nt, hsa; identical to SEQ ID NO: 210020

SEQ ID NO: 758958 - RNA, 64 nt, hsa; identical to SEQ ID NO: 210021

SEQ ID NO: 758959 - RNA, 64 nt, hsa; identical to SEQ ID NO: 210022

SEQ ID NO: 758960 - RNA, 64 nt, hsa; identical to SEQ ID NO: 210023

SEQ ID NO: 758961 - RNA, 64 nt, hsa; identical to SEQ ID NO: 210024

SEQ ID NO: 758962 - RNA, 64 nt, hsa; identical to SEQ ID NO: 210025

SEQ ID NO: 758963 - RNA, 64 nt, hsa; identical to SEQ ID NO: 210026

SEQ ID NO: 758964 - RNA, 64 nt, hsa; identical to SEQ ID NO: 210027

SEQ ID NO: 758965 - RNA, 64 nt, hsa; identical to SEQ ID NO: 210028

SEQ ID NO: 758966 - RNA, 64 nt, hsa; identical to SEQ ID NO: 210029

SEQ ID NO: 758967 - RNA, 64 nt, hsa; identical to SEQ ID NO: 210030

SEQ ID NO: 758968 - RNA, 64 nt, hsa; identical to SEQ ID NO: 210031

SEQ ID NO: 758969 - RNA, 64 nt, hsa; identical to SEQ ID NO: 210032

SEQ ID NO: 758970 - RNA, 64 nt, hsa; identical to SEQ ID NO: 210033

SEQ ID NO: 758971 - RNA, 64 nt, hsa; identical to SEQ ID NO: 210034

SEQ ID NO: 758972 - RNA, 64 nt, hsa; identical to SEQ ID NO: 210035

SEQ ID NO: 758973 - RNA, 64 nt, hsa; identical to SEQ ID NO: 210036

SEQ ID NO: 758974 - RNA, 64 nt, hsa; identical to SEQ ID NO: 210037

SEQ ID NO: 758975 - RNA, 64 nt, hsa; identical to SEQ ID NO: 210038

SEQ ID NO: 758976 - RNA, 64 nt, hsa; identical to SEQ ID NO: 210039

SEQ ID NO: 758977 - RNA, 64 nt, hsa; identical to SEQ ID NO: 210040

SEQ ID NO: 758978 - RNA, 64 nt, hsa; identical to SEQ ID NO: 210041

SEQ ID NO: 758979 - RNA, 64 nt, hsa; identical to SEQ ID NO: 210042

SEQ ID NO: 758980 - RNA, 64 nt, hsa; identical to SEQ ID NO: 210043

SEQ ID NO: 758981 - RNA, 64 nt, hsa; identical to SEQ ID NO: 210044

SEQ ID NO: 758982 - RNA, 64 nt, hsa; identical to SEQ ID NO: 210045

SEQ ID NO: 758983 - RNA, 64 nt, hsa; identical to SEQ ID NO: 210046

SEQ ID NO: 758984 - RNA, 64 nt, hsa; identical to SEQ ID NO: 210047

SEQ ID NO: 758985 - RNA, 64 nt, hsa; identical to SEQ ID NO: 210048

SEQ ID NO: 758986 - RNA, 64 nt, hsa; identical to SEQ ID NO: 210049

SEQ ID NO: 758987 - RNA, 64 nt, hsa; identical to SEQ ID NO: 210050

SEQ ID NO: 758988 - RNA, 64 nt, hsa; identical to SEQ ID NO: 210051

SEQ ID NO: 758989 - RNA, 64 nt, hsa; identical to SEQ ID NO: 210052

SEQ ID NO: 758990 - RNA, 56 nt, hsa; identical to SEQ ID NO: 210053

SEQ ID NO: 758991 - RNA, 64 nt, hsa; identical to SEQ ID NO: 210054

SEQ ID NO: 758992 - RNA, 64 nt, hsa; identical to SEQ ID NO: 210055

SEQ ID NO: 758993 - RNA, 64 nt, hsa; identical to SEQ ID NO: 210056

SEQ ID NO: 758994 - RNA, 64 nt, hsa; identical to SEQ ID NO: 210057

SEQ ID NO: 758995 - RNA, 64 nt, hsa; identical to SEQ ID NO: 210058

SEQ ID NO: 758996 - RNA, 64 nt, hsa; identical to SEQ ID NO: 210059

SEQ ID NO: 758997 - RNA, 64 nt, hsa; identical to SEQ ID NO: 210060

SEQ ID NO: 758998 - RNA, 64 nt, hsa; identical to SEQ ID NO: 210061

SEQ ID NO: 758999 - RNA, 64 nt, hsa; identical to SEQ ID NO: 210062

SEQ ID NO: 759000 - RNA, 64 nt, hsa; identical to SEQ ID NO: 210063

SEQ ID NO: 759001 - RNA, 64 nt, hsa; identical to SEQ ID NO: 210064

SEQ ID NO: 759002 - RNA, 64 nt, hsa; identical to SEQ ID NO: 210065

SEQ ID NO: 759003 - RNA, 64 nt, hsa; identical to SEQ ID NO: 210066

SEQ ID NO: 759004 - RNA, 64 nt, hsa; identical to SEQ ID NO: 210067

SEQ ID NO: 759005 - RNA, 64 nt, hsa; identical to SEQ ID NO: 210068

SEQ ID NO: 759006 - RNA, 64 nt, hsa; identical to SEQ ID NO: 210069

SEQ ID NO: 759007 - RNA, 64 nt, hsa; identical to SEQ ID NO: 210070

SEQ ID NO: 759008 - RNA, 55 nt, hsa; identical to SEQ ID NO: 210071

SEQ ID NO: 759009 - RNA, 64 nt, hsa; identical to SEQ ID NO: 210072

SEQ ID NO: 759010 - RNA, 64 nt, hsa; identical to SEQ ID NO: 210073

SEQ ID NO: 759011 - RNA, 64 nt, hsa; identical to SEQ ID NO: 210074

SEQ ID NO: 759012 - RNA, 64 nt, hsa; identical to SEQ ID NO: 210075

SEQ ID NO: 759013 - RNA, 64 nt, hsa; identical to SEQ ID NO: 210076

SEQ ID NO: 759014 - RNA, 64 nt, hsa; identical to SEQ ID NO: 210077

SEQ ID NO: 759015 - RNA, 64 nt, hsa; identical to SEQ ID NO: 210078

SEQ ID NO: 759016 - RNA, 64 nt, hsa; identical to SEQ ID NO: 210079

SEQ ID NO: 759017 - RNA, 64 nt, hsa; identical to SEQ ID NO: 210080

SEQ ID NO: 759018 - RNA, 64 nt, hsa; identical to SEQ ID NO: 210081

SEQ ID NO: 759019 - RNA, 64 nt, hsa; identical to SEQ ID NO: 210082

SEQ ID NO: 759020 - RNA, 64 nt, hsa; identical to SEQ ID NO: 210083

SEQ ID NO: 759021 - RNA, 64 nt, hsa; identical to SEQ ID NO: 210084

SEQ ID NO: 759022 - RNA, 64 nt, hsa; identical to SEQ ID NO: 210085

SEQ ID NO: 759023 - RNA, 64 nt, hsa; identical to SEQ ID NO: 210086

SEQ ID NO: 759024 - RNA, 64 nt, hsa; identical to SEQ ID NO: 210087

SEQ ID NO: 759025 - RNA, 64 nt, hsa; identical to SEQ ID NO: 210088

SEQ ID NO: 759026 - RNA, 64 nt, hsa; identical to SEQ ID NO: 210089

SEQ ID NO: 759027 - RNA, 64 nt, hsa; identical to SEQ ID NO: 210090

SEQ ID NO: 759028 - RNA, 64 nt, hsa; identical to SEQ ID NO: 210091

SEQ ID NO: 759029 - RNA, 64 nt, hsa; identical to SEQ ID NO: 210092

SEQ ID NO: 759030 - RNA, 64 nt, hsa; identical to SEQ ID NO: 210093

SEQ ID NO: 759031 - RNA, 64 nt, hsa; identical to SEQ ID NO: 210094

SEQ ID NO: 759032 - RNA, 64 nt, hsa; identical to SEQ ID NO: 210095

SEQ ID NO: 759033 - RNA, 64 nt, hsa; identical to SEQ ID NO: 210096

SEQ ID NO: 759034 - RNA, 64 nt, hsa; identical to SEQ ID NO: 210097

SEQ ID NO: 759035 - RNA, 64 nt, hsa; identical to SEQ ID NO: 210098

SEQ ID NO: 759036 - RNA, 64 nt, hsa; identical to SEQ ID NO: 210099

SEQ ID NO: 759037 - RNA, 64 nt, hsa; identical to SEQ ID NO: 210100

SEQ ID NO: 759038 - RNA, 64 nt, hsa; identical to SEQ ID NO: 210101

SEQ ID NO: 759039 - RNA, 64 nt, hsa; identical to SEQ ID NO: 210102

SEQ ID NO: 759040 - RNA, 64 nt, hsa; identical to SEQ ID NO: 210103

SEQ ID NO: 759041 - RNA, 64 nt, hsa; identical to SEQ ID NO: 210104

SEQ ID NO: 759042 - RNA, 64 nt, hsa; identical to SEQ ID NO: 210105

SEQ ID NO: 759043 - RNA, 64 nt, hsa; identical to SEQ ID NO: 210106

SEQ ID NO: 759044 - RNA, 64 nt, hsa; identical to SEQ ID NO: 210107

SEQ ID NO: 759045 - RNA, 64 nt, hsa; identical to SEQ ID NO: 210108

SEQ ID NO: 759046 - RNA, 64 nt, hsa; identical to SEQ ID NO: 210109

SEQ ID NO: 759047 - RNA, 64 nt, hsa; identical to SEQ ID NO: 210110

SEQ ID NO: 759048 - RNA, 64 nt, hsa; identical to SEQ ID NO: 210111

SEQ ID NO: 759049 - RNA, 64 nt, hsa; identical to SEQ ID NO: 210112

SEQ ID NO: 759050 - RNA, 64 nt, hsa; identical to SEQ ID NO: 210113

SEQ ID NO: 759051 - RNA, 63 nt, hsa; identical to SEQ ID NO: 210114

SEQ ID NO: 759052 - RNA, 60 nt, hsa; identical to SEQ ID NO: 210115

SEQ ID NO: 759053 - RNA, 57 nt, hsa; identical to SEQ ID NO: 210116

SEQ ID NO: 759054 - RNA, 64 nt, hsa; identical to SEQ ID NO: 210117

SEQ ID NO: 759055 - RNA, 64 nt, hsa; identical to SEQ ID NO: 210118

SEQ ID NO: 759056 - RNA, 64 nt, hsa; identical to SEQ ID NO: 210119

SEQ ID NO: 759057 - RNA, 64 nt, hsa; identical to SEQ ID NO: 210120

SEQ ID NO: 759058 - RNA, 64 nt, hsa; identical to SEQ ID NO: 210121

SEQ ID NO: 759059 - RNA, 64 nt, hsa; identical to SEQ ID NO: 210122

SEQ ID NO: 759060 - RNA, 64 nt, hsa; identical to SEQ ID NO: 210123

SEQ ID NO: 759061 - RNA, 64 nt, hsa; identical to SEQ ID NO: 210124

SEQ ID NO: 759062 - RNA, 64 nt, hsa; identical to SEQ ID NO: 210125

SEQ ID NO: 759063 - RNA, 64 nt, hsa; identical to SEQ ID NO: 210126

SEQ ID NO: 759064 - RNA, 64 nt, hsa; identical to SEQ ID NO: 210127

SEQ ID NO: 759065 - RNA, 64 nt, hsa; identical to SEQ ID NO: 210128

SEQ ID NO: 759066 - RNA, 64 nt, hsa; identical to SEQ ID NO: 210129

SEQ ID NO: 759067 - RNA, 64 nt, hsa; identical to SEQ ID NO: 210130

SEQ ID NO: 759068 - RNA, 64 nt, hsa; identical to SEQ ID NO: 210131

SEQ ID NO: 759069 - RNA, 60 nt, hsa
uuaaugguguuacagcauuugcaaaaauuauucugcuaaguauuuacaacucuauuuauu

SEQ ID NO: 759070 - RNA, 60 nt, hsa
uugucgugguuaccagugcagccugucaaauucugcuauuugacacagcuuuggaaagau

SEQ ID NO: 759071 - RNA, 60 nt, hsa
cuaacuccugcacagccccguccucuuccuuucugcuagccuggcuaaaucugcucauua

SEQ ID NO: 759072 - RNA, 60 nt, hsa
caaguaccgaccauagagcaagaaucaagauucugcuaacuccugcacagccccguccuc

SEQ ID NO: 759073 - RNA, 60 nt, hsa
cucacagcuuaauauuugguaaugaauaaauucugcuagugguauauguugaucugaacu

SEQ ID NO: 759074 - RNA, 60 nt, hsa
cacacuugaccaucuacuuuguauaacacauucugcuaaggcccagggauacaauggcaa

SEQ ID NO: 759075 - RNA, 60 nt, hsa
ugucauccccacuuuagucacgagaucuuuuucugcuaacuguucauagucuguguagug

SEQ ID NO: 759076 - RNA, 60 nt, hsa
gcugguucuaauauuaacagaacugcagucuucugcuagccaauagcauuuaccugaugg

SEQ ID NO: 759077 - RNA, 64 nt, hsa
ccuugccaugcuguuggccuggaaguccaccugucugguccauagugacguccugaagagccag

SEQ ID NO: 759078 - RNA, 64 nt, hsa
uuuucaucuugccugggaagcccaggaauuccaccugguccacaccggcagaaguuacaguaga

SEQ ID NO: 759079 - RNA, 64 nt, hsa
uccuggacccagcaggggcagaaggaggaagggacugguccaggcaugggucccuucccccugc

SEQ ID NO: 759080 - RNA, 64 nt, hsa
ccauccccauguguuucagguggaacaggaggaacugguccaggccaggccucauccuccugga

SEQ ID NO: 759081 - RNA, 64 nt, hsa
cugaagccccucugugucucuucucagggacaggcugguccaguggcuuuggugagggcgccuc

SEQ ID NO: 759082 - RNA, 64 nt, hsa
agguaggcagggcgucccuggcucaccaaugcgucugguccacauggcauuugggaaagcagau

SEQ ID NO: 759083 - RNA, 64 nt, hsa
uuucucucucccauaacagugcagugauagucagcugguccaggccaggcaaggggcuggucca

SEQ ID NO: 759084 - RNA, 64 nt, hsa
agugauagucagcugguccaggccaggcaaggggcugguccaugaugucaucaggcacccaggu

SEQ ID NO: 759085 - RNA, 64 nt, hsa
ugguguucacuuugcuccucuugcccucugucuucugguccaggcagaucaggggcucugggga

SEQ ID NO: 759086 - RNA, 64 nt, hsa
ucuggagaagugacacaggauuuacuggggugggcugguccagguagcucuccugaaccuccuc

SEQ ID NO: 759087 - RNA, 64 nt, hsa
ggcuggagucuggcugguccaacacagauucugccugguccaacacagauucugccugagccuc

SEQ ID NO: 759088 - RNA, 64 nt, hsa
agcugccuggccacugggcugggcuggagucuggcugguccaacacagauucugccugguccaa

SEQ ID NO: 759089 - RNA, 64 nt, hsa; identical to SEQ ID NO: 352415

SEQ ID NO: 759090 - RNA, 64 nt, hsa; identical to SEQ ID NO: 352416

SEQ ID NO: 759091 - RNA, 64 nt, hsa; identical to SEQ ID NO: 352417

SEQ ID NO: 759092 - RNA, 64 nt, hsa; identical to SEQ ID NO: 352418

SEQ ID NO: 759093 - RNA, 64 nt, hsa; identical to SEQ ID NO: 352419

SEQ ID NO: 759094 - RNA, 64 nt, hsa; identical to SEQ ID NO: 352420

SEQ ID NO: 759095 - RNA, 64 nt, hsa; identical to SEQ ID NO: 352421

SEQ ID NO: 759096 - RNA, 64 nt, hsa; identical to SEQ ID NO: 352422

SEQ ID NO: 759097 - RNA, 64 nt, hsa; identical to SEQ ID NO: 352423

SEQ ID NO: 759098 - RNA, 64 nt, hsa; identical to SEQ ID NO: 352424

SEQ ID NO: 759099 - RNA, 64 nt, hsa; identical to SEQ ID NO: 352425

SEQ ID NO: 759100 - RNA, 64 nt, hsa; identical to SEQ ID NO: 352426

SEQ ID NO: 759101 - RNA, 64 nt, hsa; identical to SEQ ID NO: 352427

SEQ ID NO: 759102 - RNA, 64 nt, hsa; identical to SEQ ID NO: 352428

SEQ ID NO: 759103 - RNA, 64 nt, hsa; identical to SEQ ID NO: 352429

SEQ ID NO: 759104 - RNA, 64 nt, hsa; identical to SEQ ID NO: 352430

SEQ ID NO: 759105 - RNA, 64 nt, hsa; identical to SEQ ID NO: 352431

SEQ ID NO: 759106 - RNA, 64 nt, hsa; identical to SEQ ID NO: 352432

SEQ ID NO: 759107 - RNA, 64 nt, hsa; identical to SEQ ID NO: 352433

SEQ ID NO: 759108 - RNA, 64 nt, hsa; identical to SEQ ID NO: 352434

SEQ ID NO: 759109 - RNA, 64 nt, hsa; identical to SEQ ID NO: 352435

SEQ ID NO: 759110 - RNA, 64 nt, hsa; identical to SEQ ID NO: 352436

SEQ ID NO: 759111 - RNA, 64 nt, hsa; identical to SEQ ID NO: 352437

SEQ ID NO: 759112 - RNA, 64 nt, hsa; identical to SEQ ID NO: 352438

SEQ ID NO: 759113 - RNA, 64 nt, hsa; identical to SEQ ID NO: 352439

SEQ ID NO: 759114 - RNA, 64 nt, hsa; identical to SEQ ID NO: 352440

SEQ ID NO: 759115 - RNA, 64 nt, hsa; identical to SEQ ID NO: 352441

SEQ ID NO: 759116 - RNA, 64 nt, hsa; identical to SEQ ID NO: 352442

SEQ ID NO: 759117 - RNA, 64 nt, hsa; identical to SEQ ID NO: 352443

SEQ ID NO: 759118 - RNA, 64 nt, hsa; identical to SEQ ID NO: 352444

SEQ ID NO: 759119 - RNA, 64 nt, hsa; identical to SEQ ID NO: 352445

SEQ ID NO: 759120 - RNA, 64 nt, hsa; identical to SEQ ID NO: 352446

SEQ ID NO: 759121 - RNA, 64 nt, hsa; identical to SEQ ID NO: 352447

SEQ ID NO: 759122 - RNA, 64 nt, hsa; identical to SEQ ID NO: 352448

SEQ ID NO: 759123 - RNA, 64 nt, hsa; identical to SEQ ID NO: 352449

SEQ ID NO: 759124 - RNA, 64 nt, hsa; identical to SEQ ID NO: 352450

SEQ ID NO: 759125 - RNA, 64 nt, hsa; identical to SEQ ID NO: 352451

SEQ ID NO: 759126 - RNA, 64 nt, hsa; identical to SEQ ID NO: 352452

SEQ ID NO: 759127 - RNA, 64 nt, hsa; identical to SEQ ID NO: 352453

SEQ ID NO: 759128 - RNA, 64 nt, hsa; identical to SEQ ID NO: 352454

SEQ ID NO: 759129 - RNA, 64 nt, hsa; identical to SEQ ID NO: 352455

SEQ ID NO: 759130 - RNA, 64 nt, hsa; identical to SEQ ID NO: 352456

SEQ ID NO: 759131 - RNA, 64 nt, hsa; identical to SEQ ID NO: 352457

SEQ ID NO: 759132 - RNA, 64 nt, hsa; identical to SEQ ID NO: 352458

SEQ ID NO: 759133 - RNA, 64 nt, hsa; identical to SEQ ID NO: 352459

SEQ ID NO: 759134 - RNA, 64 nt, hsa; identical to SEQ ID NO: 352460

SEQ ID NO: 759135 - RNA, 64 nt, hsa; identical to SEQ ID NO: 352461

SEQ ID NO: 759136 - RNA, 64 nt, hsa; identical to SEQ ID NO: 352462

SEQ ID NO: 759137 - RNA, 64 nt, hsa; identical to SEQ ID NO: 352463

SEQ ID NO: 759138 - RNA, 64 nt, hsa; identical to SEQ ID NO: 352464

SEQ ID NO: 759139 - RNA, 64 nt, hsa; identical to SEQ ID NO: 352465

SEQ ID NO: 759140 - RNA, 64 nt, hsa; identical to SEQ ID NO: 352466

SEQ ID NO: 759141 - RNA, 64 nt, hsa; identical to SEQ ID NO: 175633

SEQ ID NO: 759142 - RNA, 64 nt, hsa; identical to SEQ ID NO: 175634

SEQ ID NO: 759143 - RNA, 64 nt, hsa; identical to SEQ ID NO: 175635

SEQ ID NO: 759144 - RNA, 64 nt, hsa; identical to SEQ ID NO: 175636

SEQ ID NO: 759145 - RNA, 64 nt, hsa; identical to SEQ ID NO: 175637

SEQ ID NO: 759146 - RNA, 64 nt, hsa; identical to SEQ ID NO: 175638

SEQ ID NO: 759147 - RNA, 64 nt, hsa; identical to SEQ ID NO: 175639

SEQ ID NO: 759148 - RNA, 64 nt, hsa; identical to SEQ ID NO: 175640

SEQ ID NO: 759149 - RNA, 64 nt, hsa; identical to SEQ ID NO: 175641

SEQ ID NO: 759150 - RNA, 64 nt, hsa; identical to SEQ ID NO: 175642

SEQ ID NO: 759151 - RNA, 64 nt, hsa; identical to SEQ ID NO: 175643

SEQ ID NO: 759152 - RNA, 64 nt, hsa; identical to SEQ ID NO: 175644

SEQ ID NO: 759153 - RNA, 64 nt, hsa; identical to SEQ ID NO: 175645

SEQ ID NO: 759154 - RNA, 64 nt, hsa; identical to SEQ ID NO: 175646

SEQ ID NO: 759155 - RNA, 64 nt, hsa; identical to SEQ ID NO: 175647

SEQ ID NO: 759156 - RNA, 64 nt, hsa; identical to SEQ ID NO: 175648

SEQ ID NO: 759157 - RNA, 64 nt, hsa; identical to SEQ ID NO: 175649

SEQ ID NO: 759158 - RNA, 64 nt, hsa; identical to SEQ ID NO: 175650

SEQ ID NO: 759159 - RNA, 64 nt, hsa; identical to SEQ ID NO: 175651

SEQ ID NO: 759160 - RNA, 64 nt, hsa; identical to SEQ ID NO: 175652

SEQ ID NO: 759161 - RNA, 64 nt, hsa; identical to SEQ ID NO: 175653

SEQ ID NO: 759162 - RNA, 64 nt, hsa; identical to SEQ ID NO: 175654

SEQ ID NO: 759163 - RNA, 64 nt, hsa; identical to SEQ ID NO: 175655

SEQ ID NO: 759164 - RNA, 64 nt, hsa; identical to SEQ ID NO: 175656

SEQ ID NO: 759165 - RNA, 64 nt, hsa; identical to SEQ ID NO: 175657

SEQ ID NO: 759166 - RNA, 64 nt, hsa; identical to SEQ ID NO: 175658

SEQ ID NO: 759167 - RNA, 64 nt, hsa; identical to SEQ ID NO: 175659

SEQ ID NO: 759168 - RNA, 64 nt, hsa; identical to SEQ ID NO: 175660

SEQ ID NO: 759169 - RNA, 64 nt, hsa; identical to SEQ ID NO: 175661

SEQ ID NO: 759170 - RNA, 64 nt, hsa; identical to SEQ ID NO: 175662

SEQ ID NO: 759171 - RNA, 64 nt, hsa; identical to SEQ ID NO: 175663

SEQ ID NO: 759172 - RNA, 64 nt, hsa; identical to SEQ ID NO: 175664

SEQ ID NO: 759173 - RNA, 64 nt, hsa; identical to SEQ ID NO: 175665

SEQ ID NO: 759174 - RNA, 64 nt, hsa; identical to SEQ ID NO: 175666

SEQ ID NO: 759175 - RNA, 64 nt, hsa; identical to SEQ ID NO: 175667

SEQ ID NO: 759176 - RNA, 64 nt, hsa; identical to SEQ ID NO: 175668

SEQ ID NO: 759177 - RNA, 64 nt, hsa; identical to SEQ ID NO: 175669

SEQ ID NO: 759178 - RNA, 64 nt, hsa; identical to SEQ ID NO: 175670

SEQ ID NO: 759179 - RNA, 64 nt, hsa; identical to SEQ ID NO: 175671

SEQ ID NO: 759180 - RNA, 64 nt, hsa; identical to SEQ ID NO: 175672

SEQ ID NO: 759181 - RNA, 64 nt, hsa; identical to SEQ ID NO: 175673

SEQ ID NO: 759182 - RNA, 64 nt, hsa; identical to SEQ ID NO: 175674

SEQ ID NO: 759183 - RNA, 64 nt, hsa; identical to SEQ ID NO: 175675

SEQ ID NO: 759184 - RNA, 64 nt, hsa; identical to SEQ ID NO: 175676

SEQ ID NO: 759185 - RNA, 64 nt, hsa; identical to SEQ ID NO: 175677

SEQ ID NO: 759186 - RNA, 64 nt, hsa; identical to SEQ ID NO: 175678

SEQ ID NO: 759187 - RNA, 64 nt, hsa; identical to SEQ ID NO: 175679

SEQ ID NO: 759188 - RNA, 64 nt, hsa; identical to SEQ ID NO: 175680

SEQ ID NO: 759189 - RNA, 64 nt, hsa; identical to SEQ ID NO: 175681

SEQ ID NO: 759190 - RNA, 64 nt, hsa; identical to SEQ ID NO: 175682

SEQ ID NO: 759191 - RNA, 64 nt, hsa; identical to SEQ ID NO: 175683

SEQ ID NO: 759192 - RNA, 64 nt, hsa; identical to SEQ ID NO: 175684

SEQ ID NO: 759193 - RNA, 64 nt, hsa; identical to SEQ ID NO: 175685

SEQ ID NO: 759194 - RNA, 64 nt, hsa; identical to SEQ ID NO: 175686

SEQ ID NO: 759195 - RNA, 64 nt, hsa; identical to SEQ ID NO: 175687

SEQ ID NO: 759196 - RNA, 64 nt, hsa; identical to SEQ ID NO: 175688

SEQ ID NO: 759197 - RNA, 64 nt, hsa; identical to SEQ ID NO: 175689

SEQ ID NO: 759198 - RNA, 64 nt, hsa; identical to SEQ ID NO: 175690

SEQ ID NO: 759199 - RNA, 64 nt, hsa; identical to SEQ ID NO: 175691

SEQ ID NO: 759200 - RNA, 64 nt, hsa; identical to SEQ ID NO: 175692

SEQ ID NO: 759201 - RNA, 64 nt, hsa; identical to SEQ ID NO: 175693

SEQ ID NO: 759202 - RNA, 64 nt, hsa; identical to SEQ ID NO: 175694

SEQ ID NO: 759203 - RNA, 64 nt, hsa; identical to SEQ ID NO: 175695

SEQ ID NO: 759204 - RNA, 64 nt, hsa; identical to SEQ ID NO: 175696

SEQ ID NO: 759205 - RNA, 64 nt, hsa; identical to SEQ ID NO: 175697

SEQ ID NO: 759206 - RNA, 64 nt, hsa; identical to SEQ ID NO: 175698

SEQ ID NO: 759207 - RNA, 64 nt, hsa; identical to SEQ ID NO: 175699

SEQ ID NO: 759208 - RNA, 64 nt, hsa; identical to SEQ ID NO: 175700

SEQ ID NO: 759209 - RNA, 64 nt, hsa; identical to SEQ ID NO: 175701

SEQ ID NO: 759210 - RNA, 64 nt, hsa; identical to SEQ ID NO: 175702

SEQ ID NO: 759211 - RNA, 64 nt, hsa; identical to SEQ ID NO: 175703

SEQ ID NO: 759212 - RNA, 64 nt, hsa; identical to SEQ ID NO: 175704

SEQ ID NO: 759213 - RNA, 64 nt, hsa; identical to SEQ ID NO: 175705

SEQ ID NO: 759214 - RNA, 64 nt, hsa; identical to SEQ ID NO: 175706

SEQ ID NO: 759215 - RNA, 64 nt, hsa; identical to SEQ ID NO: 175707

SEQ ID NO: 759216 - RNA, 64 nt, hsa; identical to SEQ ID NO: 175708

SEQ ID NO: 759217 - RNA, 64 nt, hsa; identical to SEQ ID NO: 175709

SEQ ID NO: 759218 - RNA, 64 nt, hsa; identical to SEQ ID NO: 175710

SEQ ID NO: 759219 - RNA, 64 nt, hsa; identical to SEQ ID NO: 175711

SEQ ID NO: 759220 - RNA, 64 nt, hsa; identical to SEQ ID NO: 175712

SEQ ID NO: 759221 - RNA, 64 nt, hsa; identical to SEQ ID NO: 175713

SEQ ID NO: 759222 - RNA, 64 nt, hsa; identical to SEQ ID NO: 175714

SEQ ID NO: 759223 - RNA, 64 nt, hsa; identical to SEQ ID NO: 175715

SEQ ID NO: 759224 - RNA, 64 nt, hsa; identical to SEQ ID NO: 175716

SEQ ID NO: 759225 - RNA, 64 nt, hsa; identical to SEQ ID NO: 175717

SEQ ID NO: 759226 - RNA, 64 nt, hsa; identical to SEQ ID NO: 175718

SEQ ID NO: 759227 - RNA, 64 nt, hsa; identical to SEQ ID NO: 175719

SEQ ID NO: 759228 - RNA, 64 nt, hsa; identical to SEQ ID NO: 175720

SEQ ID NO: 759229 - RNA, 64 nt, hsa; identical to SEQ ID NO: 175721

SEQ ID NO: 759230 - RNA, 64 nt, hsa; identical to SEQ ID NO: 175722

SEQ ID NO: 759231 - RNA, 64 nt, hsa; identical to SEQ ID NO: 175723

SEQ ID NO: 759232 - RNA, 64 nt, hsa; identical to SEQ ID NO: 175724

SEQ ID NO: 759233 - RNA, 64 nt, hsa; identical to SEQ ID NO: 175725

SEQ ID NO: 759234 - RNA, 64 nt, hsa; identical to SEQ ID NO: 175726

SEQ ID NO: 759235 - RNA, 64 nt, hsa; identical to SEQ ID NO: 175727

SEQ ID NO: 759236 - RNA, 53 nt, hsa; identical to SEQ ID NO: 615283

SEQ ID NO: 759237 - RNA, 64 nt, hsa; identical to SEQ ID NO: 615284

SEQ ID NO: 759238 - RNA, 64 nt, hsa; identical to SEQ ID NO: 615285

SEQ ID NO: 759239 - RNA, 64 nt, hsa; identical to SEQ ID NO: 615286

SEQ ID NO: 759240 - RNA, 64 nt, hsa; identical to SEQ ID NO: 615287

SEQ ID NO: 759241 - RNA, 64 nt, hsa; identical to SEQ ID NO: 615288

SEQ ID NO: 759242 - RNA, 64 nt, hsa; identical to SEQ ID NO: 615289

SEQ ID NO: 759243 - RNA, 64 nt, hsa; identical to SEQ ID NO: 615290

SEQ ID NO: 759244 - RNA, 64 nt, hsa; identical to SEQ ID NO: 615291

SEQ ID NO: 759245 - RNA, 62 nt, hsa; identical to SEQ ID NO: 615292

SEQ ID NO: 759246 - RNA, 64 nt, hsa; identical to SEQ ID NO: 615293

SEQ ID NO: 759247 - RNA, 64 nt, hsa; identical to SEQ ID NO: 615294

SEQ ID NO: 759248 - RNA, 64 nt, hsa; identical to SEQ ID NO: 615295

SEQ ID NO: 759249 - RNA, 64 nt, hsa; identical to SEQ ID NO: 615296

SEQ ID NO: 759250 - RNA, 64 nt, hsa; identical to SEQ ID NO: 615297

SEQ ID NO: 759251 - RNA, 64 nt, hsa; identical to SEQ ID NO: 615298

SEQ ID NO: 759252 - RNA, 64 nt, hsa; identical to SEQ ID NO: 615299

SEQ ID NO: 759253 - RNA, 64 nt, hsa; identical to SEQ ID NO: 615300

SEQ ID NO: 759254 - RNA, 64 nt, hsa; identical to SEQ ID NO: 615301

SEQ ID NO: 759255 - RNA, 64 nt, hsa; identical to SEQ ID NO: 615302

SEQ ID NO: 759256 - RNA, 64 nt, hsa; identical to SEQ ID NO: 615303

SEQ ID NO: 759257 - RNA, 64 nt, hsa; identical to SEQ ID NO: 615304

SEQ ID NO: 759258 - RNA, 64 nt, hsa; identical to SEQ ID NO: 615305

SEQ ID NO: 759259 - RNA, 64 nt, hsa; identical to SEQ ID NO: 615306

SEQ ID NO: 759260 - RNA, 64 nt, hsa; identical to SEQ ID NO: 615307

SEQ ID NO: 759261 - RNA, 64 nt, hsa; identical to SEQ ID NO: 615308

SEQ ID NO: 759262 - RNA, 64 nt, hsa; identical to SEQ ID NO: 615309

SEQ ID NO: 759263 - RNA, 64 nt, hsa; identical to SEQ ID NO: 615310

SEQ ID NO: 759264 - RNA, 64 nt, hsa; identical to SEQ ID NO: 615311

SEQ ID NO: 759265 - RNA, 64 nt, hsa
ugaauuuuggcaugaugacuguacucucaauaaaggcugaaaauguuguauaacugaccugugu

SEQ ID NO: 759266 - RNA, 64 nt, hsa
augaauaaugaccuuaugaaguaugcuaucuguaggcugaaauuauagguacaucuguuuucac

SEQ ID NO: 759267 - RNA, 64 nt, hsa
ucacuauucacaggacauuggcauuaucuacuaaggcugaaaaugugcauauuccaugacucag

SEQ ID NO: 759268 - RNA, 64 nt, hsa
aaauaauaacagacaaggucaaaaaauagaugcaggcugaaaagaaaaggaagugggcuaagau

SEQ ID NO: 759269 - RNA, 64 nt, hsa
uauacccgugaagcaugacuuauuguaagauguuggcugaaagcaugaacuugcagaacucccu

SEQ ID NO: 759270 - RNA, 64 nt, hsa
uucccuuuuguugaucuacuugaccaagcaaaggggcugaaaaacugaauaaggaaacaacuuu

SEQ ID NO: 759271 - RNA, 60 nt, hsa
cucccaaagagccauuucaacagagaagggaaaugacaaaggggcagcuggccagauaag

SEQ ID NO: 759272 - RNA, 60 nt, hsa
agagauaaucgugucuuaaaaguuguuuuuaaaugacaauaaaacaagccagaaugucuu

SEQ ID NO: 759273 - RNA, 60 nt, hsa
gaaccuuuccagagaagucccauuaguaagaaaugacauaaaauacgugcuuucucaggu

SEQ ID NO: 759274 - RNA, 60 nt, hsa
uaaaauccaggccuagacucaagguauuguaaaugacaagauaccaaauacaagauuuua

SEQ ID NO: 759275 - RNA, 60 nt, hsa
gccaauuauuaauuugcuaaauaguaauacaaaugacaaacugcauuaaauuuacuaauu

SEQ ID NO: 759276 - RNA, 60 nt, hsa
cccccacccuuuuuuccuuaaauaaaguaaaaaugacaccuauuuuauguggcaugaguu

SEQ ID NO: 759277 - RNA, 60 nt, hsa
cucacuccacacuggcacguuugugagaagaaaugacauuuugcuaggaagugaccgagu

SEQ ID NO: 759278 - RNA, 60 nt, hsa
uuugcaauaaaagguauugagccauuuuuuaaaugacauuuuugauaaauuauguuugua

SEQ ID NO: 759279 - RNA, 60 nt, hsa
uuagaaaaauggggagaaagcuggaagaacaaaugacaugcucaaauguauugcauaagu

SEQ ID NO: 759280 - RNA, 60 nt, hsa
auucagaaaucauauaauagcugguggucaaaaugacauguugagaucauuguuguuuca

SEQ ID NO: 759281 - RNA, 60 nt, hsa
accuucuaggucuuaaaaucacacauuggaaaaugacaauaucaacaaaacuguauucuu

SEQ ID NO: 759282 - RNA, 60 nt, hsa
aaucagcaaaauaauaaaaugaacgaaaaaaaaugacacccagggaguucccaaccccag

SEQ ID NO: 759283 - RNA, 60 nt, hsa
ugggaugggaaggaaugggcaaagagauuaaaaugacagaaguuagcuguagaugaccua

SEQ ID NO: 759284 - RNA, 60 nt, hsa
ucacuuuugaaauaaaccaucgagaacacaaaaugacaagugaguuagguugggcugaug

SEQ ID NO: 759285 - RNA, 60 nt, hsa
aaucacaaaugaucauacuuaagugagcaaaaaugacaaguuuuacuagcuaaguagaga

SEQ ID NO: 759286 - RNA, 60 nt, hsa
agaacauacauguaccaguuuuuggauacuaaaugacagccuuguuucuccccuuugaau

SEQ ID NO: 759287 - RNA, 60 nt, hsa
gcucccagcaaccgccacguacaaggucugaaaugacaagggcaagagugagauaggaaa

SEQ ID NO: 759288 - RNA, 60 nt, hsa
guauaugccacuauauaaauuuguauuaauaaaugacagucuuguugguuuuuuguuugu

SEQ ID NO: 759289 - RNA, 60 nt, hsa
uaaaguugaacuuuguauggcuugaaaaagaaaugacaauauggaacaucccaaggcugu

SEQ ID NO: 759290 - RNA, 60 nt, hsa
ugaacugauguuucauuuauauuuucauccaaaugacauuaucugcacguuuuuaaaauu

SEQ ID NO: 759291 - RNA, 60 nt, hsa
gagaauuuaucauuacuguuacauuuguacaaaugacaugauaauaaaaguuuuaugaaa

SEQ ID NO: 759292 - RNA, 60 nt, hsa
gggagaccauaaugugucagccaccuugauaaaugacaggguggggaacuggaggguggg

SEQ ID NO: 759293 - RNA, 60 nt, hsa
auguaauccaucagggauucauuacuuggaaaaugacaggucaugcauuauccaaaaaca

SEQ ID NO: 759294 - RNA, 60 nt, hsa
aaaaacaauaccaaaaagacauauuuuauaaaaugacaaaaaauauuuuacauaauuacu

SEQ ID NO: 759295 - RNA, 60 nt, hsa
guacuaucaggauuuuacagcaaugcugggaaaugacagggaaaaugacaggaaugaauc

SEQ ID NO: 759296 - RNA, 60 nt, hsa
uuuuacagcaaugcugggaaaugacagggaaaaugacaggaaugaaucucaccagauuuu

SEQ ID NO: 759297 - RNA, 60 nt, hsa
uaccguuuugucuauaagauacacaaguauaaaugacaaguacaaauaacaaugaauguu

SEQ ID NO: 759298 - RNA, 60 nt, hsa
ugucucuugacuaauugacaaaguguaaugaaaugacaagcugguugaagcugguaauca

SEQ ID NO: 759299 - RNA, 60 nt, hsa
acuacuguguuaugcaaaagcaagcugauuaaaugacacucauauaauuauauguuguaa

SEQ ID NO: 759300 - RNA, 60 nt, hsa
uuaugaagaaggugaauagccauauuuguaaaaugacaaucauguguguuaacccagugc

SEQ ID NO: 759301 - RNA, 60 nt, hsa
ccacuaaaagauuauuuaauuccagauuggaaaugacauuuuaguuuaucagauugguaa

SEQ ID NO: 759302 - RNA, 60 nt, hsa
gugacuugguuucucuuuguccuuuuggaaaaaugacaagcauugcaucccagucuugug

SEQ ID NO: 759303 - RNA, 60 nt, hsa
ucauuuccuuacaauacuguccgguggacaaaaugacaauugauauguuuuucugauaua

SEQ ID NO: 759304 - RNA, 60 nt, hsa
cuagucuaacggucuuguaguuagagaucuaaaugacauuuuaucauguuuuccugcagc

SEQ ID NO: 759305 - RNA, 60 nt, hsa
guauuguucugcaguguugaaacagaauggaaaugacaagaaauaucugcaguuauccag

SEQ ID NO: 759306 - RNA, 53 nt, hsa; identical to SEQ ID NO: 540794

SEQ ID NO: 759307 - RNA, 60 nt, hsa
ugacccguuccagguccccugggcucccucaaaugacagaccuaacuauuccuguguaaa

SEQ ID NO: 759308 - RNA, 60 nt, hsa
gagauguucgcucgugcaguacuguugguuaaaugacaauuuauguggauuuugcaugua

SEQ ID NO: 759309 - RNA, 60 nt, hsa
uguaaaaauuagauuuaaauaguauauuuuaaaugacagaacuauaauuacagagaucag

SEQ ID NO: 759310 - RNA, 60 nt, hsa
ugcauaaggcuguugucuucggcuugggugaaaugacaguuccucuucauucuaaagguu

SEQ ID NO: 759311 - RNA, 60 nt, hsa
acagacuuauuuucauaaugcaaauuaauaaaaugacacuuuuacugcacuauagaaaua

SEQ ID NO: 759312 - RNA, 60 nt, hsa
ucacaccuugaauaagcauaauaccauaaaaaaugacacuugacaugucaauguauuugu

SEQ ID NO: 759313 - RNA, 60 nt, hsa
aguauagugcagauucuauguaaaacuacuaaaugacacuggaauauguuuaguagauua

SEQ ID NO: 759314 - RNA, 60 nt, hsa
uguacauagagaagaaaauuugguuuuagcaaaugacagagccuucaaaaauauuuuugg

SEQ ID NO: 759315 - RNA, 60 nt, hsa
ugaaauaaaggaagauacuaguuuugcugaaaaugacauuaaggaaaguucugcuguuuu

SEQ ID NO: 759316 - RNA, 60 nt, hsa
acuaauucaugguuguuccaaagauaauagaaaugacacagaaggcuuuaaguauccauu

SEQ ID NO: 759317 - RNA, 60 nt, hsa
ugcaaaaggagaucuaaaaaacacaaucagaaaugacaaaggggacauuaccaccaaccc

SEQ ID NO: 759318 - RNA, 60 nt, hsa
aagcuggaagcauuccccuugagaacuggaaaaugacagggaugaccacucucaccacuc

SEQ ID NO: 759319 - RNA, 60 nt, hsa
aagcaucuacucuuuuuaucauuuacuucaaaaugacauugcuaaagacugcauuauuuu

SEQ ID NO: 759320 - RNA, 60 nt, hsa
uguuuuuuuaacuuuacuauaaagccaugcaaaugacaaaaaucuauauuacuuucucaa

SEQ ID NO: 759321 - RNA, 60 nt, hsa
uuuauuuacauuuaaacuugucaggguauaaaaugacaucccauuaauuauauuguuaau

SEQ ID NO: 759322 - RNA, 60 nt, hsa
aaccagaaauccaguuauuuuccgcccucaaaaugacagccauggccggccgggugcuuc

SEQ ID NO: 759323 - RNA, 60 nt, hsa
ucaucuuuccuugccuaugacauguguauaaaaugacauugugggagcuguucgauuuuu

SEQ ID NO: 759324 - RNA, 60 nt, hsa
gcccauuagccaguuuagcauuuacuuuaaaaaugacaugaggcagauucuuauccagga

SEQ ID NO: 759325 - RNA, 64 nt, hsa; identical to SEQ ID NO: 293143

SEQ ID NO: 759326 - RNA, 64 nt, hsa; identical to SEQ ID NO: 293144

SEQ ID NO: 759327 - RNA, 64 nt, hsa; identical to SEQ ID NO: 293145

SEQ ID NO: 759328 - RNA, 64 nt, hsa; identical to SEQ ID NO: 293146

SEQ ID NO: 759329 - RNA, 64 nt, hsa; identical to SEQ ID NO: 293147

SEQ ID NO: 759330 - RNA, 64 nt, hsa; identical to SEQ ID NO: 293148

SEQ ID NO: 759331 - RNA, 64 nt, hsa; identical to SEQ ID NO: 293149

SEQ ID NO: 759332 - RNA, 64 nt, hsa; identical to SEQ ID NO: 293150

SEQ ID NO: 759333 - RNA, 64 nt, hsa; identical to SEQ ID NO: 293151

SEQ ID NO: 759334 - RNA, 64 nt, hsa; identical to SEQ ID NO: 293152

SEQ ID NO: 759335 - RNA, 64 nt, hsa; identical to SEQ ID NO: 293153

SEQ ID NO: 759336 - RNA, 64 nt, hsa; identical to SEQ ID NO: 293154

SEQ ID NO: 759337 - RNA, 64 nt, hsa; identical to SEQ ID NO: 293155

SEQ ID NO: 759338 - RNA, 64 nt, hsa; identical to SEQ ID NO: 293156

SEQ ID NO: 759339 - RNA, 64 nt, hsa; identical to SEQ ID NO: 293157

SEQ ID NO: 759340 - RNA, 64 nt, hsa; identical to SEQ ID NO: 293158

SEQ ID NO: 759341 - RNA, 64 nt, hsa; identical to SEQ ID NO: 293159

SEQ ID NO: 759342 - RNA, 64 nt, hsa; identical to SEQ ID NO: 293160

SEQ ID NO: 759343 - RNA, 64 nt, hsa; identical to SEQ ID NO: 293161

SEQ ID NO: 759344 - RNA, 64 nt, hsa; identical to SEQ ID NO: 293162

SEQ ID NO: 759345 - RNA, 64 nt, hsa; identical to SEQ ID NO: 293163

SEQ ID NO: 759346 - RNA, 64 nt, hsa; identical to SEQ ID NO: 293164

SEQ ID NO: 759347 - RNA, 64 nt, hsa; identical to SEQ ID NO: 293165

SEQ ID NO: 759348 - RNA, 64 nt, hsa; identical to SEQ ID NO: 293166

SEQ ID NO: 759349 - RNA, 64 nt, hsa; identical to SEQ ID NO: 293167

SEQ ID NO: 759350 - RNA, 64 nt, hsa; identical to SEQ ID NO: 293168

SEQ ID NO: 759351 - RNA, 64 nt, hsa; identical to SEQ ID NO: 293169

SEQ ID NO: 759352 - RNA, 64 nt, hsa; identical to SEQ ID NO: 293170

SEQ ID NO: 759353 - RNA, 64 nt, hsa; identical to SEQ ID NO: 293171

SEQ ID NO: 759354 - RNA, 64 nt, hsa; identical to SEQ ID NO: 293172

SEQ ID NO: 759355 - RNA, 64 nt, hsa; identical to SEQ ID NO: 293173

SEQ ID NO: 759356 - RNA, 64 nt, hsa; identical to SEQ ID NO: 293174

SEQ ID NO: 759357 - RNA, 64 nt, hsa; identical to SEQ ID NO: 293175

SEQ ID NO: 759358 - RNA, 64 nt, hsa; identical to SEQ ID NO: 293176

SEQ ID NO: 759359 - RNA, 64 nt, hsa; identical to SEQ ID NO: 293177

SEQ ID NO: 759360 - RNA, 64 nt, hsa; identical to SEQ ID NO: 293178

SEQ ID NO: 759361 - RNA, 63 nt, hsa; identical to SEQ ID NO: 293179

SEQ ID NO: 759362 - RNA, 64 nt, hsa; identical to SEQ ID NO: 293180

SEQ ID NO: 759363 - RNA, 64 nt, hsa; identical to SEQ ID NO: 293181

SEQ ID NO: 759364 - RNA, 64 nt, hsa; identical to SEQ ID NO: 293182

SEQ ID NO: 759365 - RNA, 64 nt, hsa; identical to SEQ ID NO: 293183

SEQ ID NO: 759366 - RNA, 64 nt, hsa; identical to SEQ ID NO: 293184

SEQ ID NO: 759367 - RNA, 64 nt, hsa; identical to SEQ ID NO: 293185

SEQ ID NO: 759368 - RNA, 64 nt, hsa; identical to SEQ ID NO: 293186

SEQ ID NO: 759369 - RNA, 64 nt, hsa; identical to SEQ ID NO: 293187

SEQ ID NO: 759370 - RNA, 64 nt, hsa; identical to SEQ ID NO: 293188

SEQ ID NO: 759371 - RNA, 64 nt, hsa; identical to SEQ ID NO: 293189

SEQ ID NO: 759372 - RNA, 64 nt, hsa; identical to SEQ ID NO: 293190

SEQ ID NO: 759373 - RNA, 64 nt, hsa; identical to SEQ ID NO: 293191

SEQ ID NO: 759374 - RNA, 64 nt, hsa; identical to SEQ ID NO: 293192

SEQ ID NO: 759375 - RNA, 64 nt, hsa; identical to SEQ ID NO: 293193

SEQ ID NO: 759376 - RNA, 64 nt, hsa; identical to SEQ ID NO: 293194

SEQ ID NO: 759377 - RNA, 64 nt, hsa; identical to SEQ ID NO: 293195

SEQ ID NO: 759378 - RNA, 53 nt, hsa; identical to SEQ ID NO: 293196

SEQ ID NO: 759379 - RNA, 64 nt, hsa; identical to SEQ ID NO: 293197

SEQ ID NO: 759380 - RNA, 64 nt, hsa; identical to SEQ ID NO: 293198

SEQ ID NO: 759381 - RNA, 64 nt, hsa; identical to SEQ ID NO: 293199

SEQ ID NO: 759382 - RNA, 64 nt, hsa; identical to SEQ ID NO: 293200

SEQ ID NO: 759383 - RNA, 64 nt, hsa; identical to SEQ ID NO: 293201

SEQ ID NO: 759384 - RNA, 64 nt, hsa; identical to SEQ ID NO: 293202

SEQ ID NO: 759385 - RNA, 64 nt, hsa; identical to SEQ ID NO: 293203

SEQ ID NO: 759386 - RNA, 64 nt, hsa; identical to SEQ ID NO: 293204

SEQ ID NO: 759387 - RNA, 64 nt, hsa; identical to SEQ ID NO: 293205

SEQ ID NO: 759388 - RNA, 64 nt, hsa; identical to SEQ ID NO: 293206

SEQ ID NO: 759389 - RNA, 64 nt, hsa; identical to SEQ ID NO: 293207

SEQ ID NO: 759390 - RNA, 64 nt, hsa; identical to SEQ ID NO: 293208

SEQ ID NO: 759391 - RNA, 64 nt, hsa; identical to SEQ ID NO: 293209

SEQ ID NO: 759392 - RNA, 64 nt, hsa; identical to SEQ ID NO: 293210

SEQ ID NO: 759393 - RNA, 64 nt, hsa; identical to SEQ ID NO: 293211

SEQ ID NO: 759394 - RNA, 64 nt, hsa; identical to SEQ ID NO: 293212

SEQ ID NO: 759395 - RNA, 64 nt, hsa; identical to SEQ ID NO: 293213

SEQ ID NO: 759396 - RNA, 64 nt, hsa; identical to SEQ ID NO: 293214

SEQ ID NO: 759397 - RNA, 64 nt, hsa; identical to SEQ ID NO: 293215

SEQ ID NO: 759398 - RNA, 64 nt, hsa; identical to SEQ ID NO: 293216

SEQ ID NO: 759399 - RNA, 64 nt, hsa; identical to SEQ ID NO: 293217

SEQ ID NO: 759400 - RNA, 64 nt, hsa; identical to SEQ ID NO: 293218

SEQ ID NO: 759401 - RNA, 64 nt, hsa; identical to SEQ ID NO: 293219

SEQ ID NO: 759402 - RNA, 64 nt, hsa; identical to SEQ ID NO: 293220

SEQ ID NO: 759403 - RNA, 64 nt, hsa; identical to SEQ ID NO: 293221

SEQ ID NO: 759404 - RNA, 64 nt, hsa; identical to SEQ ID NO: 293222

SEQ ID NO: 759405 - RNA, 64 nt, hsa; identical to SEQ ID NO: 293223

SEQ ID NO: 759406 - RNA, 64 nt, hsa; identical to SEQ ID NO: 293224

SEQ ID NO: 759407 - RNA, 64 nt, hsa; identical to SEQ ID NO: 293225

SEQ ID NO: 759408 - RNA, 64 nt, hsa; identical to SEQ ID NO: 293226

SEQ ID NO: 759409 - RNA, 64 nt, hsa; identical to SEQ ID NO: 293227

SEQ ID NO: 759410 - RNA, 64 nt, hsa; identical to SEQ ID NO: 293228

SEQ ID NO: 759411 - RNA, 64 nt, hsa; identical to SEQ ID NO: 293229

SEQ ID NO: 759412 - RNA, 64 nt, hsa; identical to SEQ ID NO: 293230

SEQ ID NO: 759413 - RNA, 64 nt, hsa; identical to SEQ ID NO: 293231

SEQ ID NO: 759414 - RNA, 59 nt, hsa; identical to SEQ ID NO: 293232

SEQ ID NO: 759415 - RNA, 64 nt, hsa; identical to SEQ ID NO: 293233

SEQ ID NO: 759416 - RNA, 64 nt, hsa; identical to SEQ ID NO: 293234

SEQ ID NO: 759417 - RNA, 64 nt, hsa; identical to SEQ ID NO: 293235

SEQ ID NO: 759418 - RNA, 64 nt, hsa; identical to SEQ ID NO: 293236

SEQ ID NO: 759419 - RNA, 64 nt, hsa; identical to SEQ ID NO: 293237

SEQ ID NO: 759420 - RNA, 64 nt, hsa; identical to SEQ ID NO: 293238

SEQ ID NO: 759421 - RNA, 64 nt, hsa; identical to SEQ ID NO: 293239

SEQ ID NO: 759422 - RNA, 64 nt, hsa; identical to SEQ ID NO: 293240

SEQ ID NO: 759423 - RNA, 64 nt, hsa; identical to SEQ ID NO: 293241

SEQ ID NO: 759424 - RNA, 64 nt, hsa; identical to SEQ ID NO: 293242

SEQ ID NO: 759425 - RNA, 64 nt, hsa; identical to SEQ ID NO: 293243

SEQ ID NO: 759426 - RNA, 64 nt, hsa; identical to SEQ ID NO: 293244

SEQ ID NO: 759427 - RNA, 64 nt, hsa; identical to SEQ ID NO: 293245

SEQ ID NO: 759428 - RNA, 64 nt, hsa; identical to SEQ ID NO: 293246

SEQ ID NO: 759429 - RNA, 64 nt, hsa; identical to SEQ ID NO: 293247

SEQ ID NO: 759430 - RNA, 64 nt, hsa; identical to SEQ ID NO: 293248

SEQ ID NO: 759431 - RNA, 64 nt, hsa; identical to SEQ ID NO: 293249

SEQ ID NO: 759432 - RNA, 64 nt, hsa; identical to SEQ ID NO: 293250

SEQ ID NO: 759433 - RNA, 64 nt, hsa; identical to SEQ ID NO: 293251

SEQ ID NO: 759434 - RNA, 64 nt, hsa; identical to SEQ ID NO: 293252

SEQ ID NO: 759435 - RNA, 64 nt, hsa; identical to SEQ ID NO: 293253

SEQ ID NO: 759436 - RNA, 64 nt, hsa; identical to SEQ ID NO: 293254

SEQ ID NO: 759437 - RNA, 64 nt, hsa; identical to SEQ ID NO: 293255

SEQ ID NO: 759438 - RNA, 64 nt, hsa; identical to SEQ ID NO: 293256

SEQ ID NO: 759439 - RNA, 64 nt, hsa; identical to SEQ ID NO: 293257

SEQ ID NO: 759440 - RNA, 64 nt, hsa; identical to SEQ ID NO: 293258

SEQ ID NO: 759441 - RNA, 64 nt, hsa; identical to SEQ ID NO: 293259

SEQ ID NO: 759442 - RNA, 64 nt, hsa; identical to SEQ ID NO: 293260

SEQ ID NO: 759443 - RNA, 64 nt, hsa; identical to SEQ ID NO: 293261

SEQ ID NO: 759444 - RNA, 64 nt, hsa; identical to SEQ ID NO: 293262

SEQ ID NO: 759445 - RNA, 64 nt, hsa; identical to SEQ ID NO: 293263

SEQ ID NO: 759446 - RNA, 64 nt, hsa; identical to SEQ ID NO: 293264

SEQ ID NO: 759447 - RNA, 64 nt, hsa; identical to SEQ ID NO: 293265

SEQ ID NO: 759448 - RNA, 64 nt, hsa; identical to SEQ ID NO: 293266

SEQ ID NO: 759449 - RNA, 64 nt, hsa; identical to SEQ ID NO: 293267

SEQ ID NO: 759450 - RNA, 64 nt, hsa; identical to SEQ ID NO: 293268

SEQ ID NO: 759451 - RNA, 64 nt, hsa; identical to SEQ ID NO: 293269

SEQ ID NO: 759452 - RNA, 62 nt, hsa
gaggcaucauuccugggccagagucguguccaccaagggacaguagccagagcuccucuucc

SEQ ID NO: 759453 - RNA, 62 nt, hsa
gaggccccgagaagcgucuucccuugaguuggccaagggaauaagcaagaggagacauuucc

SEQ ID NO: 759454 - RNA, 62 nt, hsa
acaccccagcagggugucuucuagccauaaggccaagggaguggcagaacugggccgccucu

SEQ ID NO: 759455 - RNA, 62 nt, hsa
agucacgauuccacaauggaggggagaccuggccaagggagccagccagcgugcaacugccc

SEQ ID NO: 759456 - RNA, 62 nt, hsa
gcugcugagcuagaauucccaccuaugucuuuccaagggacuguucacggcuugggacuugg

SEQ ID NO: 759457 - RNA, 62 nt, hsa
gcgcaccugcucuguagcagacacggaagaguccaagggagcagccacguuaggaagagaga

SEQ ID NO: 759458 - RNA, 62 nt, hsa
gccucauuuuagaaccaccaacaagcaagcucccaagggauggugcccuguucucuaccaag

SEQ ID NO: 759459 - RNA, 62 nt, hsa
aucagggaauuguuuuaagucuuaucaagcagccaagggaugaaagagaagguggguuuuca

SEQ ID NO: 759460 - RNA, 62 nt, hsa
ucucugaccucugcugagugcugggcacugcuccaagggacaggugggccuggcggccugug

SEQ ID NO: 759461 - RNA, 62 nt, hsa
cuccuaggggaagggggugcaaagacucugagccaagggagggaagggccacccugcugcac

SEQ ID NO: 759462 - RNA, 62 nt, hsa
cugggauggcuggccccacaagccacucaguuccaagggaugugaccagcucugagccaucg

SEQ ID NO: 759463 - RNA, 62 nt, hsa
uaagcagcugacauaagacagcccguaggcuaccaagggacaccugccugcaaaggcuguug

SEQ ID NO: 759464 - RNA, 64 nt, hsa; identical to SEQ ID NO: 670169

SEQ ID NO: 759465 - RNA, 64 nt, hsa; identical to SEQ ID NO: 670170

SEQ ID NO: 759466 - RNA, 64 nt, hsa; identical to SEQ ID NO: 670171

SEQ ID NO: 759467 - RNA, 64 nt, hsa; identical to SEQ ID NO: 670172

SEQ ID NO: 759468 - RNA, 64 nt, hsa; identical to SEQ ID NO: 670173

SEQ ID NO: 759469 - RNA, 64 nt, hsa; identical to SEQ ID NO: 670174

SEQ ID NO: 759470 - RNA, 64 nt, hsa; identical to SEQ ID NO: 670175

SEQ ID NO: 759471 - RNA, 64 nt, hsa; identical to SEQ ID NO: 670176

SEQ ID NO: 759472 - RNA, 64 nt, hsa; identical to SEQ ID NO: 670177

SEQ ID NO: 759473 - RNA, 64 nt, hsa; identical to SEQ ID NO: 670178

SEQ ID NO: 759474 - RNA, 64 nt, hsa; identical to SEQ ID NO: 670179

SEQ ID NO: 759475 - RNA, 64 nt, hsa; identical to SEQ ID NO: 670180

SEQ ID NO: 759476 - RNA, 64 nt, hsa; identical to SEQ ID NO: 670181

SEQ ID NO: 759477 - RNA, 64 nt, hsa; identical to SEQ ID NO: 670182

SEQ ID NO: 759478 - RNA, 64 nt, hsa; identical to SEQ ID NO: 670183

SEQ ID NO: 759479 - RNA, 64 nt, hsa; identical to SEQ ID NO: 670184

SEQ ID NO: 759480 - RNA, 64 nt, hsa; identical to SEQ ID NO: 670185

SEQ ID NO: 759481 - RNA, 64 nt, hsa; identical to SEQ ID NO: 670186

SEQ ID NO: 759482 - RNA, 64 nt, hsa; identical to SEQ ID NO: 670187

SEQ ID NO: 759483 - RNA, 64 nt, hsa; identical to SEQ ID NO: 670188

SEQ ID NO: 759484 - RNA, 64 nt, hsa; identical to SEQ ID NO: 670189

SEQ ID NO: 759485 - RNA, 64 nt, hsa; identical to SEQ ID NO: 670190

SEQ ID NO: 759486 - RNA, 64 nt, hsa; identical to SEQ ID NO: 670191

SEQ ID NO: 759487 - RNA, 64 nt, hsa; identical to SEQ ID NO: 670192

SEQ ID NO: 759488 - RNA, 64 nt, hsa; identical to SEQ ID NO: 670193

SEQ ID NO: 759489 - RNA, 64 nt, hsa; identical to SEQ ID NO: 670194

SEQ ID NO: 759490 - RNA, 64 nt, hsa; identical to SEQ ID NO: 670195

SEQ ID NO: 759491 - RNA, 64 nt, hsa; identical to SEQ ID NO: 670196

SEQ ID NO: 759492 - RNA, 64 nt, hsa; identical to SEQ ID NO: 670197

SEQ ID NO: 759493 - RNA, 64 nt, hsa; identical to SEQ ID NO: 670198

SEQ ID NO: 759494 - RNA, 64 nt, hsa; identical to SEQ ID NO: 670199

SEQ ID NO: 759495 - RNA, 64 nt, hsa; identical to SEQ ID NO: 670200

SEQ ID NO: 759496 - RNA, 62 nt, hsa
uuuugaaaugugucauuuuuaaacaaucuuaaaaguaauacagaauugugauuuauuaauuu

SEQ ID NO: 759497 - RNA, 62 nt, hsa
cuuagaacuuagaaguguuucuaagagaacagaaguaauaagagaaacaguuacguguggaa

SEQ ID NO: 759498 - RNA, 62 nt, hsa
auccuuaguacacagagaauauacuuuuccucaaguaauauaccuguuugaagcuuuaagag

SEQ ID NO: 759499 - RNA, 62 nt, hsa
uaucacagugaaaggcaaaauuauucacucagaaguaauauaaauuaccucuuuaaaaagua

SEQ ID NO: 759500 - RNA, 62 nt, hsa
uauguuauuaugugugaaguaauauauuguacaaguaauaaauguauuguugagauauauug

SEQ ID NO: 759501 - RNA, 62 nt, hsa
uagugaaaugauguuuuauguuauuaugugugaaguaauauauuguacaaguaauaaaugua

SEQ ID NO: 759502 - RNA, 62 nt, hsa
cuuauuucuucauuuuaagucauugcaauggaaaguaauauuauaaaaugguaauuacaaca

SEQ ID NO: 759503 - RNA, 62 nt, hsa
ugacaacguguuucugaaaaacagauuuucauaaguaauaauaaaaauaauaauaaaaaagu

SEQ ID NO: 759504 - RNA, 62 nt, hsa
aaaauuaugaauaggauauacuaauaaauacaaaguaauaacaaaagucaaagcaguguucu

SEQ ID NO: 759505 - RNA, 62 nt, hsa
agugauuaugauucuuaucccaaaauucuagaaaguaauaaauucuguaugaauaagcauaa

SEQ ID NO: 759506 - RNA, 62 nt, hsa
uucuauucaacuucuaauuugaaagcuguacaaaguaauagaaguuccauuuaaauaugagu

SEQ ID NO: 759507 - RNA, 62 nt, hsa
cauucuccuaaaaauccguaauaccauuguaaaaguaauaauuccccaauaucaucuaauca

SEQ ID NO: 759508 - RNA, 62 nt, hsa
gauaguaaaaacaccugacaacuaaacauaguaaguaauacuagacuggauucuguaccaga

SEQ ID NO: 759509 - RNA, 62 nt, hsa
aggcaggaacgggggaccauugcauugugcccaaguaauaauaaaacuauuucagauguauu

SEQ ID NO: 759510 - RNA, 62 nt, hsa
uggggagagcacucgguugucuuuacuuuuaaaaguaauacuuggugcuaagaauuucagga

SEQ ID NO: 759511 - RNA, 62 nt, hsa
gagagcaacaggccccugauuauacaguuccaaaguaauaagauguuaauuguaauucagcc

SEQ ID NO: 759512 - RNA, 62 nt, hsa
uuuagcuuuagaaagaaaugcguuauagaaacaaguaauagcaagaaaauugauguauauuu

SEQ ID NO: 759513 - RNA, 62 nt, hsa
gcauuauugggugccuuuguuuguaaaccaaaaaguaauaaaugaaucccuauauuuccauu

SEQ ID NO: 759514 - RNA, 62 nt, hsa
aauacggugguugagaaggaaccaguguuuacaaguaauaucagaaaguugaaggaaccagu

SEQ ID NO: 759515 - RNA, 62 nt, hsa
aauaucagaaaguugaaggaaccaguguuuacaaguaauaccagaaaguugccaaacccuuc

SEQ ID NO: 759516 - RNA, 62 nt, hsa
uaccaccuaaaacugaauuuuaucauauaagcaaguaauaccuauuagucauaccuaaauuu

SEQ ID NO: 759517 - RNA, 62 nt, hsa
caggcuuuaccgguuuuuuuaguuguuuaaauaaguaauauuuucaaaagaauaaaauaacc

SEQ ID NO: 759518 - RNA, 62 nt, hsa
aaaguaauagcuuuuguucaaacauuuuuaggaaguaauaauacauuucuuccuggacaguu

SEQ ID NO: 759519 - RNA, 62 nt, hsa
acagcaauuaccuauggagaauacaucauucaaaguaauagcuuuuguucaaacauuuuuag

SEQ ID NO: 759520 - RNA, 62 nt, hsa
uaguauaacaugagugaaugucauuaauuuugaaguaauaacugccacaugugggaaguagg

SEQ ID NO: 759521 - RNA, 62 nt, hsa
cuuaaauaugcuuguauagcauccacuggcagaaguaauaguugugccucagacuugggggu

SEQ ID NO: 759522 - RNA, 62 nt, hsa
uuacaaaaaacucccacuuuuuuuguuacaaaaaguaauagaaaaugguaauaguuaacauu

SEQ ID NO: 759523 - RNA, 62 nt, hsa
caccauauuuucgcuagcucaagcaguaccccaaguaauaacugaaggagcuaacuacccaa

SEQ ID NO: 759524 - RNA, 62 nt, hsa
augugucuaccaagaacaauugaguuuucuaaaaguaauaaugaagauuaugcaauucuaac

SEQ ID NO: 759525 - RNA, 62 nt, hsa
uaaucuuuuuaaauuguacagcaaggugcucuaaguaauauucgauaaaauauauuuaauag

SEQ ID NO: 759526 - RNA, 64 nt, hsa
uuccugucuugacccaauuuaugagaaagcucccaguugggacuuuaucucacaaguggaauca

SEQ ID NO: 759527 - RNA, 64 nt, hsa
aggaccacuuguuguacaucugaauaauuauggaaguugggacauguuaaggaaaacaaauaug

SEQ ID NO: 759528 - RNA, 64 nt, hsa
cugggugggagggaaacuucauuucacuggaaugaguugggagagaaaggcccucagcuuuuag

SEQ ID NO: 759529 - RNA, 64 nt, hsa
cucccaccucagacucccaaagugcuggaauuacaguugggagccacugugccuggccuggaag

SEQ ID NO: 759530 - RNA, 64 nt, hsa
acauuggggguaaauaacagacacuauauguuggaguugggaaucagauccaaguuugacucca

SEQ ID NO: 759531 - RNA, 64 nt, hsa
aaauuuucuuucuuuugagguauuccauaaaaguaguugggaaaauuauuauguaaaauaauaa

SEQ ID NO: 759532 - RNA, 64 nt, hsa
cuuugggguggggagggagggaggagggagguggaguugggauggaguauggaugucuuuuuuu

SEQ ID NO: 759533 - RNA, 64 nt, hsa
auaauacaaauucaguuugucagguuggauggugaguugggagcugugauggaucuguuggcgg

SEQ ID NO: 759534 - RNA, 64 nt, hsa
ucaacuucagaaggccucacucaagccugagagaaguugggagggugguggggacagguaagug

SEQ ID NO: 759535 - RNA, 64 nt, hsa
augacagaaugagcagucccuaaugguauugggcaguugggagugaguuuaggcagcuucucug

SEQ ID NO: 759536 - RNA, 64 nt, hsa
acugggaccugaaugaccugcagucagggcccagaguugggacucuauacuacccugggcucug

SEQ ID NO: 759537 - RNA, 64 nt, hsa
accaucucccugcugcagguuuagaggaccagugaguugggaguuauuacucaaguggcaccua

SEQ ID NO: 759538 - RNA, 64 nt, hsa
guaauugcaaguucauaaagagaauugaggguccaguugggagaacuauuagucaguucuuuua

SEQ ID NO: 759539 - RNA, 64 nt, hsa
aaggugguauguaauuuaugcaagguauuucuccaguugggacucaggauauuaguuaaugagc

SEQ ID NO: 759540 - RNA, 64 nt, hsa
cgucucuauaccaaccaaaccaauucaccaacacaguugggacccaaaacacaggaagucaguc

SEQ ID NO: 759541 - RNA, 64 nt, hsa
cugcuucuccccgaggagguugagcucuugagcaaguugggacuugggccggggccuggaagaa

SEQ ID NO: 759542 - RNA, 64 nt, hsa
gaggccgcgggagggaggccaggaggcccggaccaguugggaggagugagcaggccccggggga

SEQ ID NO: 759543 - RNA, 64 nt, hsa
gacagaugaacuuuugcauguguauauaagaaugaguugggaccucugucuuuaaaaaucuauu

SEQ ID NO: 759544 - RNA, 64 nt, hsa
ucugacuucacauguuaauagaggaucagagcagaguugggaguauauuggucaggaucauaga

SEQ ID NO: 759545 - RNA, 64 nt, hsa; identical to SEQ ID NO: 334267

SEQ ID NO: 759546 - RNA, 64 nt, hsa; identical to SEQ ID NO: 334268

SEQ ID NO: 759547 - RNA, 64 nt, hsa; identical to SEQ ID NO: 334269

SEQ ID NO: 759548 - RNA, 64 nt, hsa; identical to SEQ ID NO: 334270

SEQ ID NO: 759549 - RNA, 64 nt, hsa; identical to SEQ ID NO: 334271

SEQ ID NO: 759550 - RNA, 64 nt, hsa; identical to SEQ ID NO: 334272

SEQ ID NO: 759551 - RNA, 64 nt, hsa; identical to SEQ ID NO: 334273

SEQ ID NO: 759552 - RNA, 64 nt, hsa; identical to SEQ ID NO: 334274

SEQ ID NO: 759553 - RNA, 64 nt, hsa; identical to SEQ ID NO: 334275

SEQ ID NO: 759554 - RNA, 64 nt, hsa; identical to SEQ ID NO: 334276

SEQ ID NO: 759555 - RNA, 64 nt, hsa; identical to SEQ ID NO: 545831

SEQ ID NO: 759556 - RNA, 64 nt, hsa; identical to SEQ ID NO: 545832

SEQ ID NO: 759557 - RNA, 64 nt, hsa; identical to SEQ ID NO: 545833

SEQ ID NO: 759558 - RNA, 64 nt, hsa; identical to SEQ ID NO: 545834

SEQ ID NO: 759559 - RNA, 64 nt, hsa; identical to SEQ ID NO: 545835

SEQ ID NO: 759560 - RNA, 64 nt, hsa; identical to SEQ ID NO: 545836

SEQ ID NO: 759561 - RNA, 64 nt, hsa; identical to SEQ ID NO: 545837

SEQ ID NO: 759562 - RNA, 64 nt, hsa; identical to SEQ ID NO: 545838

SEQ ID NO: 759563 - RNA, 64 nt, hsa; identical to SEQ ID NO: 545839

SEQ ID NO: 759564 - RNA, 64 nt, hsa; identical to SEQ ID NO: 545840

SEQ ID NO: 759565 - RNA, 64 nt, hsa; identical to SEQ ID NO: 545841

SEQ ID NO: 759566 - RNA, 64 nt, hsa; identical to SEQ ID NO: 545842

SEQ ID NO: 759567 - RNA, 64 nt, hsa; identical to SEQ ID NO: 545843

SEQ ID NO: 759568 - RNA, 64 nt, hsa; identical to SEQ ID NO: 545844

SEQ ID NO: 759569 - RNA, 64 nt, hsa; identical to SEQ ID NO: 545845

SEQ ID NO: 759570 - RNA, 64 nt, hsa; identical to SEQ ID NO: 545846

SEQ ID NO: 759571 - RNA, 64 nt, hsa; identical to SEQ ID NO: 545847

SEQ ID NO: 759572 - RNA, 64 nt, hsa; identical to SEQ ID NO: 545848

SEQ ID NO: 759573 - RNA, 64 nt, hsa; identical to SEQ ID NO: 545849

SEQ ID NO: 759574 - RNA, 64 nt, hsa; identical to SEQ ID NO: 545850

SEQ ID NO: 759575 - RNA, 64 nt, hsa; identical to SEQ ID NO: 545851

SEQ ID NO: 759576 - RNA, 64 nt, hsa; identical to SEQ ID NO: 545852

SEQ ID NO: 759577 - RNA, 64 nt, hsa; identical to SEQ ID NO: 545853

SEQ ID NO: 759578 - RNA, 64 nt, hsa; identical to SEQ ID NO: 545854

SEQ ID NO: 759579 - RNA, 64 nt, hsa; identical to SEQ ID NO: 545855

SEQ ID NO: 759580 - RNA, 64 nt, hsa; identical to SEQ ID NO: 545856

SEQ ID NO: 759581 - RNA, 64 nt, hsa; identical to SEQ ID NO: 545857

SEQ ID NO: 759582 - RNA, 64 nt, hsa; identical to SEQ ID NO: 545858

SEQ ID NO: 759583 - RNA, 64 nt, hsa; identical to SEQ ID NO: 545859

SEQ ID NO: 759584 - RNA, 64 nt, hsa; identical to SEQ ID NO: 545860

SEQ ID NO: 759585 - RNA, 64 nt, hsa; identical to SEQ ID NO: 545861

SEQ ID NO: 759586 - RNA, 64 nt, hsa; identical to SEQ ID NO: 545862

SEQ ID NO: 759587 - RNA, 64 nt, hsa; identical to SEQ ID NO: 545863

SEQ ID NO: 759588 - RNA, 64 nt, hsa; identical to SEQ ID NO: 545864

SEQ ID NO: 759589 - RNA, 64 nt, hsa; identical to SEQ ID NO: 421584

SEQ ID NO: 759590 - RNA, 64 nt, hsa; identical to SEQ ID NO: 421585

SEQ ID NO: 759591 - RNA, 64 nt, hsa; identical to SEQ ID NO: 421586

SEQ ID NO: 759592 - RNA, 64 nt, hsa; identical to SEQ ID NO: 421587

SEQ ID NO: 759593 - RNA, 64 nt, hsa; identical to SEQ ID NO: 421588

SEQ ID NO: 759594 - RNA, 64 nt, hsa; identical to SEQ ID NO: 421589

SEQ ID NO: 759595 - RNA, 51 nt, hsa; identical to SEQ ID NO: 421590

SEQ ID NO: 759596 - RNA, 64 nt, hsa; identical to SEQ ID NO: 421591

SEQ ID NO: 759597 - RNA, 64 nt, hsa; identical to SEQ ID NO: 421592

SEQ ID NO: 759598 - RNA, 64 nt, hsa; identical to SEQ ID NO: 421593

SEQ ID NO: 759599 - RNA, 64 nt, hsa; identical to SEQ ID NO: 421594

SEQ ID NO: 759600 - RNA, 64 nt, hsa; identical to SEQ ID NO: 421595

SEQ ID NO: 759601 - RNA, 64 nt, hsa; identical to SEQ ID NO: 421596

SEQ ID NO: 759602 - RNA, 64 nt, hsa; identical to SEQ ID NO: 421597

SEQ ID NO: 759603 - RNA, 64 nt, hsa; identical to SEQ ID NO: 421598

SEQ ID NO: 759604 - RNA, 64 nt, hsa; identical to SEQ ID NO: 421599

SEQ ID NO: 759605 - RNA, 64 nt, hsa; identical to SEQ ID NO: 421600

SEQ ID NO: 759606 - RNA, 64 nt, hsa; identical to SEQ ID NO: 421601

SEQ ID NO: 759607 - RNA, 64 nt, hsa; identical to SEQ ID NO: 421602

SEQ ID NO: 759608 - RNA, 64 nt, hsa; identical to SEQ ID NO: 421603

SEQ ID NO: 759609 - RNA, 64 nt, hsa; identical to SEQ ID NO: 421604

SEQ ID NO: 759610 - RNA, 64 nt, hsa; identical to SEQ ID NO: 421605

SEQ ID NO: 759611 - RNA, 64 nt, hsa; identical to SEQ ID NO: 421606

SEQ ID NO: 759612 - RNA, 64 nt, hsa; identical to SEQ ID NO: 421607

SEQ ID NO: 759613 - RNA, 64 nt, hsa; identical to SEQ ID NO: 421608

SEQ ID NO: 759614 - RNA, 64 nt, hsa; identical to SEQ ID NO: 421609

SEQ ID NO: 759615 - RNA, 64 nt, hsa; identical to SEQ ID NO: 421610

SEQ ID NO: 759616 - RNA, 64 nt, hsa; identical to SEQ ID NO: 421611

SEQ ID NO: 759617 - RNA, 64 nt, hsa; identical to SEQ ID NO: 421612

SEQ ID NO: 759618 - RNA, 64 nt, hsa; identical to SEQ ID NO: 421613

SEQ ID NO: 759619 - RNA, 64 nt, hsa; identical to SEQ ID NO: 421614

SEQ ID NO: 759620 - RNA, 64 nt, hsa; identical to SEQ ID NO: 421615

SEQ ID NO: 759621 - RNA, 64 nt, hsa; identical to SEQ ID NO: 421616

SEQ ID NO: 759622 - RNA, 64 nt, hsa; identical to SEQ ID NO: 421617

SEQ ID NO: 759623 - RNA, 64 nt, hsa; identical to SEQ ID NO: 421618

SEQ ID NO: 759624 - RNA, 64 nt, hsa; identical to SEQ ID NO: 421619

SEQ ID NO: 759625 - RNA, 64 nt, hsa; identical to SEQ ID NO: 421620

SEQ ID NO: 759626 - RNA, 64 nt, hsa; identical to SEQ ID NO: 421621

SEQ ID NO: 759627 - RNA, 64 nt, hsa; identical to SEQ ID NO: 421622

SEQ ID NO: 759628 - RNA, 64 nt, hsa; identical to SEQ ID NO: 484813

SEQ ID NO: 759629 - RNA, 64 nt, hsa; identical to SEQ ID NO: 484814

SEQ ID NO: 759630 - RNA, 64 nt, hsa; identical to SEQ ID NO: 484815

SEQ ID NO: 759631 - RNA, 64 nt, hsa; identical to SEQ ID NO: 484816

SEQ ID NO: 759632 - RNA, 64 nt, hsa; identical to SEQ ID NO: 484817

SEQ ID NO: 759633 - RNA, 64 nt, hsa; identical to SEQ ID NO: 484818

SEQ ID NO: 759634 - RNA, 64 nt, hsa; identical to SEQ ID NO: 484819

SEQ ID NO: 759635 - RNA, 64 nt, hsa; identical to SEQ ID NO: 484820

SEQ ID NO: 759636 - RNA, 64 nt, hsa; identical to SEQ ID NO: 484821

SEQ ID NO: 759637 - RNA, 64 nt, hsa; identical to SEQ ID NO: 484822

SEQ ID NO: 759638 - RNA, 64 nt, hsa; identical to SEQ ID NO: 484823

SEQ ID NO: 759639 - RNA, 64 nt, hsa; identical to SEQ ID NO: 484824

SEQ ID NO: 759640 - RNA, 64 nt, hsa; identical to SEQ ID NO: 484825

SEQ ID NO: 759641 - RNA, 64 nt, hsa; identical to SEQ ID NO: 484826

SEQ ID NO: 759642 - RNA, 60 nt, hsa; identical to SEQ ID NO: 395328

SEQ ID NO: 759643 - RNA, 60 nt, hsa; identical to SEQ ID NO: 395329

SEQ ID NO: 759644 - RNA, 60 nt, hsa; identical to SEQ ID NO: 395330

SEQ ID NO: 759645 - RNA, 60 nt, hsa; identical to SEQ ID NO: 395331

SEQ ID NO: 759646 - RNA, 60 nt, hsa; identical to SEQ ID NO: 395332

SEQ ID NO: 759647 - RNA, 60 nt, hsa; identical to SEQ ID NO: 395333

SEQ ID NO: 759648 - RNA, 60 nt, hsa; identical to SEQ ID NO: 395334

SEQ ID NO: 759649 - RNA, 60 nt, hsa; identical to SEQ ID NO: 395335

SEQ ID NO: 759650 - RNA, 60 nt, hsa; identical to SEQ ID NO: 395336

SEQ ID NO: 759651 - RNA, 60 nt, hsa; identical to SEQ ID NO: 395337

SEQ ID NO: 759652 - RNA, 60 nt, hsa; identical to SEQ ID NO: 395338

SEQ ID NO: 759653 - RNA, 60 nt, hsa; identical to SEQ ID NO: 395339

SEQ ID NO: 759654 - RNA, 60 nt, hsa; identical to SEQ ID NO: 395340

SEQ ID NO: 759655 - RNA, 60 nt, hsa; identical to SEQ ID NO: 395341

SEQ ID NO: 759656 - RNA, 60 nt, hsa; identical to SEQ ID NO: 395342

SEQ ID NO: 759657 - RNA, 60 nt, hsa; identical to SEQ ID NO: 395343

SEQ ID NO: 759658 - RNA, 60 nt, hsa; identical to SEQ ID NO: 395344

SEQ ID NO: 759659 - RNA, 60 nt, hsa; identical to SEQ ID NO: 395345

SEQ ID NO: 759660 - RNA, 60 nt, hsa; identical to SEQ ID NO: 395346

SEQ ID NO: 759661 - RNA, 60 nt, hsa; identical to SEQ ID NO: 395347

SEQ ID NO: 759662 - RNA, 60 nt, hsa; identical to SEQ ID NO: 395348

SEQ ID NO: 759663 - RNA, 60 nt, hsa; identical to SEQ ID NO: 395349

SEQ ID NO: 759664 - RNA, 60 nt, hsa; identical to SEQ ID NO: 395350

SEQ ID NO: 759665 - RNA, 60 nt, hsa; identical to SEQ ID NO: 395351

SEQ ID NO: 759666 - RNA, 60 nt, hsa; identical to SEQ ID NO: 395352

SEQ ID NO: 759667 - RNA, 60 nt, hsa; identical to SEQ ID NO: 395353

SEQ ID NO: 759668 - RNA, 64 nt, hsa; identical to SEQ ID NO: 39289

SEQ ID NO: 759669 - RNA, 64 nt, hsa; identical to SEQ ID NO: 39290

SEQ ID NO: 759670 - RNA, 64 nt, hsa; identical to SEQ ID NO: 39291

SEQ ID NO: 759671 - RNA, 64 nt, hsa; identical to SEQ ID NO: 39292

SEQ ID NO: 759672 - RNA, 64 nt, hsa; identical to SEQ ID NO: 39293

SEQ ID NO: 759673 - RNA, 64 nt, hsa; identical to SEQ ID NO: 39294

SEQ ID NO: 759674 - RNA, 64 nt, hsa; identical to SEQ ID NO: 39295

SEQ ID NO: 759675 - RNA, 64 nt, hsa; identical to SEQ ID NO: 39296

SEQ ID NO: 759676 - RNA, 64 nt, hsa; identical to SEQ ID NO: 39297

SEQ ID NO: 759677 - RNA, 64 nt, hsa; identical to SEQ ID NO: 39298

SEQ ID NO: 759678 - RNA, 64 nt, hsa; identical to SEQ ID NO: 39299

SEQ ID NO: 759679 - RNA, 64 nt, hsa; identical to SEQ ID NO: 39300

SEQ ID NO: 759680 - RNA, 64 nt, hsa; identical to SEQ ID NO: 39301

SEQ ID NO: 759681 - RNA, 64 nt, hsa; identical to SEQ ID NO: 39302

SEQ ID NO: 759682 - RNA, 64 nt, hsa; identical to SEQ ID NO: 39303

SEQ ID NO: 759683 - RNA, 64 nt, hsa; identical to SEQ ID NO: 39304

SEQ ID NO: 759684 - RNA, 64 nt, hsa; identical to SEQ ID NO: 39305

SEQ ID NO: 759685 - RNA, 64 nt, hsa; identical to SEQ ID NO: 39306

SEQ ID NO: 759686 - RNA, 64 nt, hsa; identical to SEQ ID NO: 39307

SEQ ID NO: 759687 - RNA, 64 nt, hsa; identical to SEQ ID NO: 39308

SEQ ID NO: 759688 - RNA, 64 nt, hsa; identical to SEQ ID NO: 39309

SEQ ID NO: 759689 - RNA, 64 nt, hsa; identical to SEQ ID NO: 39310

SEQ ID NO: 759690 - RNA, 64 nt, hsa; identical to SEQ ID NO: 39311

SEQ ID NO: 759691 - RNA, 64 nt, hsa; identical to SEQ ID NO: 39312

SEQ ID NO: 759692 - RNA, 64 nt, hsa; identical to SEQ ID NO: 39313

SEQ ID NO: 759693 - RNA, 64 nt, hsa; identical to SEQ ID NO: 39314

SEQ ID NO: 759694 - RNA, 64 nt, hsa; identical to SEQ ID NO: 39315

SEQ ID NO: 759695 - RNA, 64 nt, hsa; identical to SEQ ID NO: 39316

SEQ ID NO: 759696 - RNA, 64 nt, hsa; identical to SEQ ID NO: 39317

SEQ ID NO: 759697 - RNA, 64 nt, hsa; identical to SEQ ID NO: 39318

SEQ ID NO: 759698 - RNA, 64 nt, hsa; identical to SEQ ID NO: 39319

SEQ ID NO: 759699 - RNA, 64 nt, hsa; identical to SEQ ID NO: 39320

SEQ ID NO: 759700 - RNA, 64 nt, hsa; identical to SEQ ID NO: 39321

SEQ ID NO: 759701 - RNA, 64 nt, hsa; identical to SEQ ID NO: 39322

SEQ ID NO: 759702 - RNA, 64 nt, hsa; identical to SEQ ID NO: 39323

SEQ ID NO: 759703 - RNA, 64 nt, hsa; identical to SEQ ID NO: 39324

SEQ ID NO: 759704 - RNA, 64 nt, hsa; identical to SEQ ID NO: 39325

SEQ ID NO: 759705 - RNA, 64 nt, hsa; identical to SEQ ID NO: 39326

SEQ ID NO: 759706 - RNA, 64 nt, hsa; identical to SEQ ID NO: 39327

SEQ ID NO: 759707 - RNA, 64 nt, hsa; identical to SEQ ID NO: 39328

SEQ ID NO: 759708 - RNA, 64 nt, hsa; identical to SEQ ID NO: 39329

SEQ ID NO: 759709 - RNA, 64 nt, hsa; identical to SEQ ID NO: 39330

SEQ ID NO: 759710 - RNA, 64 nt, hsa; identical to SEQ ID NO: 39331

SEQ ID NO: 759711 - RNA, 64 nt, hsa; identical to SEQ ID NO: 39332

SEQ ID NO: 759712 - RNA, 61 nt, hsa; identical to SEQ ID NO: 39333

SEQ ID NO: 759713 - RNA, 64 nt, hsa; identical to SEQ ID NO: 39334

SEQ ID NO: 759714 - RNA, 64 nt, hsa; identical to SEQ ID NO: 39335

SEQ ID NO: 759715 - RNA, 64 nt, hsa; identical to SEQ ID NO: 39336

SEQ ID NO: 759716 - RNA, 64 nt, hsa; identical to SEQ ID NO: 39337

SEQ ID NO: 759717 - RNA, 64 nt, hsa; identical to SEQ ID NO: 39338

SEQ ID NO: 759718 - RNA, 64 nt, hsa; identical to SEQ ID NO: 39339

SEQ ID NO: 759719 - RNA, 64 nt, hsa; identical to SEQ ID NO: 39340

SEQ ID NO: 759720 - RNA, 64 nt, hsa; identical to SEQ ID NO: 39341

SEQ ID NO: 759721 - RNA, 64 nt, hsa; identical to SEQ ID NO: 39342

SEQ ID NO: 759722 - RNA, 64 nt, hsa; identical to SEQ ID NO: 39343

SEQ ID NO: 759723 - RNA, 64 nt, hsa; identical to SEQ ID NO: 39344

SEQ ID NO: 759724 - RNA, 64 nt, hsa; identical to SEQ ID NO: 39345

SEQ ID NO: 759725 - RNA, 64 nt, hsa; identical to SEQ ID NO: 39346

SEQ ID NO: 759726 - RNA, 62 nt, hsa
caagagccauagguagccuuacuacuugggccucuuucuaguuuugaauuauuucuaagccu

SEQ ID NO: 759727 - RNA, 62 nt, hsa
cuugaacucaagaacucuuuauuuucuaucauucuuucuagacacacacacaucagacuggc

SEQ ID NO: 759728 - RNA, 62 nt, hsa
guaaaugaaacuuuguuugggucaagcuuccuucuuucuaacccccagacuuuggccucuga

SEQ ID NO: 759729 - RNA, 62 nt, hsa
gcuguccucuuucuccacuccauuugcuuggcucuuucuacaccucccucuugggcaugggc

SEQ ID NO: 759730 - RNA, 62 nt, hsa
acccagucacugcauuuuuggacuauaccguaucuuucuagcacaaggaaauagauaaacug

SEQ ID NO: 759731 - RNA, 62 nt, hsa
gaagaacuauugaugcaaguuuuuuuauuguuucuuucuaugaucagguaccugcuuucauu

SEQ ID NO: 759732 - RNA, 62 nt, hsa
uugaggauguugaaauguauuacauuuuggcuucuuucuacauguuaacugcacuguagaug

SEQ ID NO: 759733 - RNA, 62 nt, hsa
uaccuuaaauuggaagacuuuuaauugcagucucuuucuaccuucccucuguuagucauuug

SEQ ID NO: 759734 - RNA, 62 nt, hsa
uguuugaaaggaugcuaucaggcgaagugacaucuuucuaaccagauaggccauugcuuuca

SEQ ID NO: 759735 - RNA, 62 nt, hsa
ggccagugccugucccccaggcccacuuguauucuuucuacuguaaaauggcgccuuuaaaa

SEQ ID NO: 759736 - RNA, 62 nt, hsa
aagguauuauguaaaaauauuuaauaauuuauucuuucuauuacugaauuaaaaaaucagag

SEQ ID NO: 759737 - RNA, 62 nt, hsa
uauuucuugcuuauuauauguaaaguugagcuucuuucuagauauuaggccuuugaauaaaa

SEQ ID NO: 759738 - RNA, 62 nt, hsa
ggauuaggagccauaccucccagagcaagguaucuuucuagagcaaauuucucuuucuagaa

SEQ ID NO: 759739 - RNA, 62 nt, hsa
ccagagcaagguaucuuucuagagcaaauuucucuuucuagaaggggagggucacaggguca

SEQ ID NO: 759740 - RNA, 62 nt, hsa
ucacuacacaaaccaggcacucucccuuucugucuuucuaguuuccuuuccuugucucucuc

SEQ ID NO: 759741 - RNA, 62 nt, hsa
uguccacaccuaauaagugcaaucauuuugagucuuucuauguugucuagacggagggguuu

SEQ ID NO: 759742 - RNA, 62 nt, hsa
gcauucuuucuuaugaauuguauauuuagaaaucuuucuaaauaccauuaaggcuugacugg

SEQ ID NO: 759743 - RNA, 62 nt, hsa
uauaccaaguucaaaacacuuucagauagaagucuuucuaugcaaagauuaaaguaugacuu

SEQ ID NO: 759744 - RNA, 62 nt, hsa
cuauuaauaagaaaccaacaaacaagaaccucucuuucuagggauuucuaaauauauaaaau

SEQ ID NO: 759745 - RNA, 62 nt, hsa
auuucagguauaggaauuauaaaauaauugguucuuucuaaacacuugucccauuucauucu

SEQ ID NO: 759746 - RNA, 62 nt, hsa
acugaacgagcauaaauaaauguagcaaaauuucuuucuaaccugccuaaacucuaggccau

SEQ ID NO: 759747 - RNA, 62 nt, hsa
uuaguauugugugauuuucccccguuaacaugucuuucuaaaauugucuauuaaagcagagg

SEQ ID NO: 759748 - RNA, 62 nt, hsa
ccuuuucuauuugcguucaaaacuguguguucucuuucuauuccuauuugauaguuugaguc

SEQ ID NO: 759749 - RNA, 62 nt, hsa
caaaggaugacuguaggccgugugcuggccuuucuuucuaagaagcugcuuugagcuccugg

SEQ ID NO: 759750 - RNA, 62 nt, hsa
ugugaaauucguuuucuuuuucauggugccuuucuuucuaagaaaagauagaaagaaugggg

SEQ ID NO: 759751 - RNA, 62 nt, hsa
aaaaggcuucaaggaauuuaucucaacauuauucuuucuauguccuaacuaaauuucucaac

SEQ ID NO: 759752 - RNA, 62 nt, hsa
guuuuuguucuacauauuuuucaauaauuuauucuuucuaauguugaaauuauaucaggcuu

SEQ ID NO: 759753 - RNA, 62 nt, hsa
guuuguuuuuucucucucuuucuuucccuuucucuuucuaucucucuuuauuuuucuuucuu

SEQ ID NO: 759754 - RNA, 62 nt, hsa
acuugagauuuaaaaacugcuauuccuuuuguucuuucuagcaucucuccccacccucugag

SEQ ID NO: 759755 - RNA, 62 nt, hsa
uccagcuucuugcuugggcagguagaggaaguucuuucuacuuccacaggugcagcccuccc

SEQ ID NO: 759756 - RNA, 62 nt, hsa
caaccauguccgccccagcucuugaggcuggaucuuucuacuugugccacuaugggcacuag

SEQ ID NO: 759757 - RNA, 62 nt, hsa
cgugaaacccaugacaaaaugaaugugaauauucuuucuaaaaauuuagaaaauguuaucuu

SEQ ID NO: 759758 - RNA, 62 nt, hsa
guccucuuauuaugcuuuuaguuguaugagucucuuucuaugaacugaacacaaaacucagg

SEQ ID NO: 759759 - RNA, 62 nt, hsa
ucauuagaacaaugaauuauccagcauucagaucuuucuagucaccuuagaacuuuuugguu

SEQ ID NO: 759760 - RNA, 62 nt, hsa
agugguuuaugaauuguuuccuuauuugcacuucuuucuacacaacucgggcuguuuguuuu

SEQ ID NO: 759761 - RNA, 62 nt, hsa
ccucuuuucauuuucucccacaggccucucuuucuuucuagguugcuggggagaaaugggua

SEQ ID NO: 759762 - RNA, 62 nt, hsa
ucuugggaugcccugaguugcuucccauuuccucuuucuagccguccuuuucuagugugugc

SEQ ID NO: 759763 - RNA, 62 nt, hsa
gggaaagucugagugaaaggauggccucauucucuuucuaaucuugcugguuucaagauuag

SEQ ID NO: 759764 - RNA, 62 nt, hsa
auucuggguguaaagaguaaauaugcccuggcucuuucuaccaauguuugcuccugguugga

SEQ ID NO: 759765 - RNA, 62 nt, hsa
gcauauuucuuugagcacugugcuuuuaugugucuuucuacaaagggguuauuggucagugg

SEQ ID NO: 759766 - RNA, 62 nt, hsa
ccucaauccauguagggacaucugaguaugccucuuucuauugaaaugucaauucaauccca

SEQ ID NO: 759767 - RNA, 64 nt, hsa
agauaaagaauaguuuucuuccucuucuccuugggccaguuaauaauugguccauggcuacacu

SEQ ID NO: 759768 - RNA, 64 nt, hsa
ggaaugaccaagagacaaguuaacucgugcaagagccaguuacccacccacaggucccccuacu

SEQ ID NO: 759769 - RNA, 64 nt, hsa
cauugugauuuguacuaucuacaaaggaguaacugccaguuaggaagaacaguaaacagugaug

SEQ ID NO: 759770 - RNA, 64 nt, hsa
ugcaugaaucuaccugaguugcuggcauugggaggccaguuacuggaaaggaauggaaaaaaga

SEQ ID NO: 759771 - RNA, 64 nt, hsa
uugugguuuugaaguuuguacuuucucugugggugccaguuaaauauuggagagcaaggaaugu

SEQ ID NO: 759772 - RNA, 64 nt, hsa
caagacccugucucagaaaaaaagaaaauucaaggccaguuaagacaaaaugcuaugacuuuga

SEQ ID NO: 759773 - RNA, 64 nt, hsa
uuuugcuuacagcauaugguaaccaagguuagaugccaguuaaaauuccuuagaaauuggauga

SEQ ID NO: 759774 - RNA, 64 nt, hsa
ucucuauugcuuggugucauuuauaggaagcacugccaguuaaagagcauuagaagaggugguu

SEQ ID NO: 759775 - RNA, 64 nt, hsa
ggaaucaaacugccuggguuccagucccagcucugccaguuaugcccagcuguggggacuuggg

SEQ ID NO: 759776 - RNA, 64 nt, hsa
caggaaugguaucaauuccccuguuucucuuguagccaguuacuagaauaaaaucaucuacuuu

SEQ ID NO: 759777 - RNA, 64 nt, hsa
uagccuugguaucauuuucuagcaauaacugagagccaguuaauuuuaagaauuucacacauuu

SEQ ID NO: 759778 - RNA, 64 nt, hsa
aggugggugcagcugaaaguaaacagaauggauugccaguuacauguaugccugcccaguuccc

SEQ ID NO: 759779 - RNA, 64 nt, hsa
uggaucaucaaaaaaauaaaguaaaauagaaaacugagaaaacucaauccaugaccagggagaa

SEQ ID NO: 759780 - RNA, 64 nt, hsa
uuaauugguaggguaagcagacacucugaaacaaugagaaaaauacuaaaaauugacuugaguu

SEQ ID NO: 759781 - RNA, 64 nt, hsa
caguauaccuaugugugcagcaguaaaaaauuagugagaaaaagcaacuuuuugucacucuuag

SEQ ID NO: 759782 - RNA, 64 nt, hsa
agaagcaguguaguucuaccucucauuuuacagaugagaaaaccgaagcccagaaaaacucuca

SEQ ID NO: 759783 - RNA, 64 nt, hsa
ugauguuauuauauaugcuuaugaaacagauuuaugagaaaaguuuuuuuuaaauaaauuauuu

SEQ ID NO: 759784 - RNA, 64 nt, hsa
guuauauuuguuuuccuguauuuagguggagaaaugagaaaaagcuuuaguuccaauugacagu

SEQ ID NO: 759785 - RNA, 64 nt, hsa
aggcaguguaacaaccuauagugccauugauccaugagaaaaagauuuucugguacuacuccaa

SEQ ID NO: 759786 - RNA, 64 nt, hsa
aacuuuuaauuuuuauuuuggcaaaacugucaaaugagaaaaaugauuuuaaaaacuuuuuuuu

SEQ ID NO: 759787 - RNA, 64 nt, hsa
gaucugccaaguggauacuggggugccacuccccugagaaaagacugagccaggaacuacaagc

SEQ ID NO: 759788 - RNA, 64 nt, hsa
ggggcauugaggagcuuccucauucugggaaaacugagaaaacccauauucuccuaauacaacc

SEQ ID NO: 759789 - RNA, 64 nt, hsa
uaaguuccguuauauacuguggccugaaauaauuugagaaaaaagguuacuuuguuauucagcu

SEQ ID NO: 759790 - RNA, 64 nt, hsa
aggucaguuugauuggauacuuaaguuuuagaaaugagaaaaauacagaguuuuagaaaugaga

SEQ ID NO: 759791 - RNA, 64 nt, hsa
caugcacacacacaaaaaauaccuaaauuuuggaugagaaaaugauaaaauaugcuaaguucua

SEQ ID NO: 759792 - RNA, 64 nt, hsa
uggugggaugguaauggggauuagagaacugacaugagaaaagaggagcuguuuugguauuaaa

SEQ ID NO: 759793 - RNA, 64 nt, hsa
ccuucaauccuggccaaguuggaguagacugguaugagaaaacuaugauuaguucacauuuacu

SEQ ID NO: 759794 - RNA, 64 nt, hsa
uacuuguacuucuaauaacauuuuucaugaaucaugagaaaauuuccacagauacuucccuuag

SEQ ID NO: 759795 - RNA, 64 nt, hsa
auauuuauagagcaucaaucaauauaagcauuauugagaaaaaugugacccguaacacuguguu

SEQ ID NO: 759796 - RNA, 64 nt, hsa
gaaauacgacagggugugguagaauucagcaauaugagaaaaccagccccuaaaaugauagcca

SEQ ID NO: 759797 - RNA, 64 nt, hsa
gaacacucuuagaauucccauuuaauaaaccauaugagaaaacccucuauuacucuuacacuuu

SEQ ID NO: 759798 - RNA, 64 nt, hsa
aauaugacuagaaaaauuaguguuauauugggugugagaaaagacugugucuugaaagaauuau

SEQ ID NO: 759799 - RNA, 64 nt, hsa
aucaauccuaacuagaaauacuaaaaauggcuuuugagaaaaauacuuccucugcuuguauuuu

SEQ ID NO: 759800 - RNA, 64 nt, hsa
aucacuguuaaagccauugacuccuuuaguacacugagaaaaaucuuauaguaaaacuagccuu

SEQ ID NO: 759801 - RNA, 64 nt, hsa
acuguacagacuguuuacuaaggagcuaaaccacugagaaaacguuauuaaaauuguaauaccu

SEQ ID NO: 759802 - RNA, 64 nt, hsa
auuuguguacaauauacccauugaauguauauccugagaaaaauuggggccaaagaagcaggaa

SEQ ID NO: 759803 - RNA, 64 nt, hsa
auucauaaaaaaaaucaaguagcugaugugcaguugagaaaacuagaggacugaaaaaacaaau

SEQ ID NO: 759804 - RNA, 64 nt, hsa
uauacuugaccaagcaccaugaucccuaggggcaugagaaaagcacauaauggauguggaugug

SEQ ID NO: 759805 - RNA, 64 nt, hsa
ucuauauaggugauuuuaccagguuuaguuauccugagaaaacaucuggacuuaagaguuucug

SEQ ID NO: 759806 - RNA, 64 nt, hsa
gucuucuuauguugacuaaaauuauaguuagagcugagaaaaaaaaaauagcaucuaguccaac

SEQ ID NO: 759807 - RNA, 64 nt, hsa
gucacagguaaaaucaguguugggaauuauaauuugagaaaaauauuacccaguaacauugaau

SEQ ID NO: 759808 - RNA, 64 nt, hsa
aguacaagcuauuaaaaaucagauugaaaaguuuugagaaaauguuauuuuuacugaaagcaag

SEQ ID NO: 759809 - RNA, 64 nt, hsa
cucacaccuuauugcacaggaaagcauuuauacuugagaaaaauuguauaaagaauauggaaaa

SEQ ID NO: 759810 - RNA, 64 nt, hsa
uacauguucagacuaacauucuuuugcaguauagugagaaaaaaacauuuuaaaauuaauuauc

SEQ ID NO: 759811 - RNA, 64 nt, hsa
uuaacauuuugcacagaauauaucaaauauauuuugagaaaaaaaguacggcaugaguucuguu

SEQ ID NO: 759812 - RNA, 64 nt, hsa
cacaaaaaaucuuauuucagaauggaaauauuuuugagaaaaguagcugaguauacugguuuaa

SEQ ID NO: 759813 - RNA, 64 nt, hsa
gaggaggagaaagaauccaaagauucucacugccugagaaaacccaggcaauacuauuuuaaag

SEQ ID NO: 759814 - RNA, 64 nt, hsa
ugggcgacagaucugaagugaagacaggagaugaugagaaaagcucaccgcaucagcugguugc

SEQ ID NO: 759815 - RNA, 64 nt, hsa
acucauuccuuagucaauaccagcauuuuuccagugagaaaacuaucuugacaggauaguggaa

SEQ ID NO: 759816 - RNA, 64 nt, hsa
gggggacaaaacauaaagccaucaagcacgugcuugagaaaaaaauuauaauuuugaauaaaga

SEQ ID NO: 759817 - RNA, 64 nt, hsa
uuguguaggacucuguaaucuuuugauuaguuucugagaaaacacaaugaagcacuucacuuuu

SEQ ID NO: 759818 - RNA, 64 nt, hsa
auuuuaauuauaguuuuguuauaaauauaacuuaugagaaaaaaauuugauaggaauaauacug

SEQ ID NO: 759819 - RNA, 64 nt, hsa
caaaauaauugagaaaaauaaauaacaagauaauugagaaaaaaauaaaauaaauucccaauuc

SEQ ID NO: 759820 - RNA, 64 nt, hsa
ggccaaacuugagccaaucugagagcaaaauaauugagaaaaauaaauaacaagauaauugaga

SEQ ID NO: 759821 - RNA, 64 nt, hsa
aaacuauuucagauguauuauaugauugagcaaaugagaaaacauguugauguugaugggaguc

SEQ ID NO: 759822 - RNA, 64 nt, hsa
cuugauccacuaugccuuaaugguuuccuccauuugagaaaauaaagcuauucacauuguuaag

SEQ ID NO: 759823 - RNA, 64 nt, hsa
aacaguuuuuauuaaaacaugagucacuaugggaugagaaaauugaaauaaagcuacugggccu

SEQ ID NO: 759824 - RNA, 64 nt, hsa
uucuucauuacugcauugaaaaggaaaaccugucugagaaaaugccugacaguuuaauuuaaaa

SEQ ID NO: 759825 - RNA, 64 nt, hsa
aauugcccccauguguaggggacacagaacccuuugagaaaacuuagauuuuugucuguacaaa

SEQ ID NO: 759826 - RNA, 64 nt, hsa
auuuuacugccuuuccuuuuaauuuuuguuugaaugagaaaaguuuaauacaacagguguccag

SEQ ID NO: 759827 - RNA, 64 nt, hsa
aauacuccauccccuucccucccagugaauggaaugagaaaagccuucuuccuuugcuucaggc

SEQ ID NO: 759828 - RNA, 64 nt, hsa
aacaaaaaaauaauaaucaaaugccuucaauuucugagaaaaugaggcagagcauggaaaagga

SEQ ID NO: 759829 - RNA, 64 nt, hsa
ggcagggcccaaggccccagguuuucauuuuucaugagaaaagcuuuccaagugccuggccaga

SEQ ID NO: 759830 - RNA, 64 nt, hsa
guugguuucuaacagacuacuuccaaaaacaguuugagaaaaaaacugucugauuuuaagucuc

SEQ ID NO: 759831 - RNA, 64 nt, hsa
guuuagaauuacaaaauaguuuuuaaauauugucugagaaaagccaaaguuaaugcaaccuagu

SEQ ID NO: 759832 - RNA, 64 nt, hsa
uuguuuuucucccuaaucuaucagcugcacuacuugagaaaauuuaaaguguuucuaguuaaau

SEQ ID NO: 759833 - RNA, 64 nt, hsa
uccaaaucuacuguacugucagcuucacuccaccugagaaaaaagaaaaaaaaauugauagcuc

SEQ ID NO: 759834 - RNA, 64 nt, hsa
ucugcacagaaagucccaguacaacuuccauugcugagaaaauccucagaggacuuucccacuu

SEQ ID NO: 759835 - RNA, 64 nt, hsa
gaaaaaaaucaguaccacauuuggacaguauaggugagaaaacauaauuauaaaaaugaugcca

SEQ ID NO: 759836 - RNA, 64 nt, hsa
aaggaagaaaauguagauuagaaaauaagacuucugagaaaaaguucaaggaauaaagauuguu

SEQ ID NO: 759837 - RNA, 64 nt, hsa
ugugaucacuaaaaugaggccaagguuuaggaggugagaaaaaguaucccuuuuacggauucag

SEQ ID NO: 759838 - RNA, 64 nt, hsa
uuucaaaccacacauuaguacuuauguugcacaaugagaaaagaaauuaguuucaaauuuaccu

SEQ ID NO: 759839 - RNA, 64 nt, hsa
uuuuuucaacaaaauggucauccaaacucaaacuugagaaaauaucuugcuuucaaauuggcac

SEQ ID NO: 759840 - RNA, 64 nt, hsa
uguuuugguaauuauuucauauauuguuguuuauugagaaaagguuguaggaugugucacaaga

SEQ ID NO: 759841 - RNA, 64 nt, hsa
uaaccugcaucccauuuccagccucuuuucaagcugagaaaaaaaaaaaaaaacacguuugaua

SEQ ID NO: 759842 - RNA, 64 nt, hsa
uguuaagccaggacuguuaucuccauuuaacagaugagaaaauggagguuuauggucuguucuc

SEQ ID NO: 759843 - RNA, 64 nt, hsa
aauuaucucugccuucaaggagcuugcaguauagugagaaaagccugccaaguaaaucagcagg

SEQ ID NO: 759844 - RNA, 64 nt, hsa
uuaaucauaacuaaaacauugaaaacagaacaaaugagaaaagaaaaaaaaccugccgauuaac

SEQ ID NO: 759845 - RNA, 64 nt, hsa
aguuccugcuuucuuuugcgguaggacuuggcugugagaaaaucaccuaaaucccagaaaagag

SEQ ID NO: 759846 - RNA, 64 nt, hsa
uucaaaaguaauuaauaguguuggaagauguaggugagaaaauauuccugaaaguagaacugaa

SEQ ID NO: 759847 - RNA, 64 nt, hsa
uuuuacaaaugaaaugauaggcaucuauguaaagugagaaaaauauguuucguaaauauuugca

SEQ ID NO: 759848 - RNA, 64 nt, hsa
gaaauguccaagggguugggggaagauauuacuuugagaaaacagaaauguaaaggauuuuuga

SEQ ID NO: 759849 - RNA, 64 nt, hsa
ucacagacuugagagcaauaaaugcaaaccuaaaugagaaaauggaaucccugacagcuguguc

SEQ ID NO: 759850 - RNA, 64 nt, hsa
cuggaagaaggggguaaaaguuugcuuuggugagugagaaaaggcuggggcgugugauccaucc

SEQ ID NO: 759851 - RNA, 64 nt, hsa
gcugaaugacauucaagcugauuuucuagaccacugagaaaaucuuuauuuacaauaaauuuca

SEQ ID NO: 759852 - RNA, 64 nt, hsa
auauuuuaggacauuaugucuaaaaauuguauacugagaaaaauccuaugaauguggcagacua

SEQ ID NO: 759853 - RNA, 64 nt, hsa
uguuuugugucagagaaaacauguacaaaacauuugagaaaauauuuuaggacauuaugucuaa

SEQ ID NO: 759854 - RNA, 64 nt, hsa
gugauuacaugguccuucaaacucccaaccaaagugagaaaagcggcaugcagugaaaugagca

SEQ ID NO: 759855 - RNA, 64 nt, hsa
gagagagauaaccugucugucauaacuuaaaggaugagaaaaugugguguagcuauuaaagauu

SEQ ID NO: 759856 - RNA, 64 nt, hsa
augaagagaaggaggguugugcccacuucauagaugagaaaacugagaggugaggugacuugcc

SEQ ID NO: 759857 - RNA, 64 nt, hsa
ccauuugccagauugccccauugcucacacuacuugagaaaaugcaggagagcuucccccaagg

SEQ ID NO: 759858 - RNA, 64 nt, hsa
ugggaagagaaggaauaaauuugucaaaacuaggugagaaaauagagcauugugggaaaaacug

SEQ ID NO: 759859 - RNA, 64 nt, hsa
uacuuuaauguuuagggucaguuuguaguauucuugagaaaaagauaaaggguuauaauuugaa

SEQ ID NO: 759860 - RNA, 64 nt, hsa
acaucaccaacuuaauuuucuuccauagcaaaacugagaaaauaccuuguuucaguauaacacu

SEQ ID NO: 759861 - RNA, 64 nt, hsa
uuaugucacacacacaaaaaauccuuuucaauccugagaaaauuaaaggcguuuuacucacaug

SEQ ID NO: 759862 - RNA, 64 nt, hsa
uuaauuucaaauagaauauggacuuaaauguuaaugagaaaauggcuuuaaucaauucuagcau

SEQ ID NO: 759863 - RNA, 64 nt, hsa
uauuggaagauaaacuugucaaacuugucaagaaugagaaaagccaaauuagaaaauccuaugu

SEQ ID NO: 759864 - RNA, 64 nt, hsa
ugcuaucuauaaaaaagagaaaaaagaaaaaaaaugagaaaaaaguaagaaaaaaaaaaauccu

SEQ ID NO: 759865 - RNA, 64 nt, hsa
uggaaagaaguuauagaaucuucauagaguucuaugagaaaaaauauacuugcuaucuauaaaa

SEQ ID NO: 759866 - RNA, 64 nt, hsa
auguuuuauugaaauuagauucauuucucuaaugugagaaaaauauauccaguaauaguauuga

SEQ ID NO: 759867 - RNA, 64 nt, hsa
aaggauaauauauuuuccccaucaaugcugauucugagaaaagagcaauuuaucaaaauuaaac

SEQ ID NO: 759868 - RNA, 64 nt, hsa
acaucaccaacuugauuuucuuccauagcaaaacugagaaaauaccuuguuucaguauaacacu

SEQ ID NO: 759869 - RNA, 64 nt, hsa
uaugucacacacacaaaaaaauccuuuucaauccugagaaaauuaaagguguuuuacucacaug

SEQ ID NO: 759870 - RNA, 64 nt, hsa
uucuggaucucuuaguagggggaaaguagaaaaucgaguagaauuuggccucaggucaauaaau

SEQ ID NO: 759871 - RNA, 64 nt, hsa
acuucccgucucagaaucuaaacguggucaccuucgaguagagaggcccgcccgcccaccgugg

SEQ ID NO: 759872 - RNA, 64 nt, hsa
cagaacguggcugcccaggggcugccuaucugggcgaguagaccgccuggcucagcccacaggc

SEQ ID NO: 759873 - RNA, 64 nt, hsa
ccugggcucaagccaucccccaaccuuggccucucgaguagaugggauuauaggcaugugccac

SEQ ID NO: 759874 - RNA, 64 nt, hsa
cuucaccuuugcuucuacauagagauguuaaugucgaguagaaagaaauguaucuuagcaucug

SEQ ID NO: 759875 - RNA, 64 nt, hsa
ccuacaugggcuuugugcccagaucuugucagagcgaguagaggucaguggugaugccucuugc

SEQ ID NO: 759876 - RNA, 64 nt, hsa
uucgggcccgcggugcucggggccugguguggggcgaguagagacuuccccagccuggacgggc

SEQ ID NO: 759877 - RNA, 64 nt, hsa
aggguuuuuuuuuuuugacaaauucaacauucaacgaguagacaaaaugcuaauuauuucccug

SEQ ID NO: 759878 - RNA, 64 nt, hsa
aauuguuagaaagcaucaggaugaccaguuaucucgaguagauuuucuuggauuucagaacauc

SEQ ID NO: 759879 - RNA, 64 nt, hsa
acuguauuuguuaauuucuugcaauuugaagguacgaguagagguuuaaagaaaaaucaguuuu

SEQ ID NO: 759880 - RNA, 64 nt, hsa
uauuuuuaaacacuuuuuuucauaauacauauuccgaguagauauuuauaaaauauauguuucu

SEQ ID NO: 759881 - RNA, 64 nt, hsa
aagaaaagcccaaagggaaacccacgauuccuuucgaguagaugugggaaagagcccauuggag

SEQ ID NO: 759882 - RNA, 64 nt, hsa
gccaugccagcuggccuuuguaagugcaggaaaccgaguagaaaaugugacccuccaaauggag

SEQ ID NO: 759883 - RNA, 64 nt, hsa
gucacagugcaauuaggccagaaaggaucuuguucgaguagaagccacagucauugaaaagaca

SEQ ID NO: 759884 - RNA, 64 nt, hsa
guguuguguagaacucuuuuuaaacucuaugcuccgaguagaguucaucuuuauauuaaacuuc

SEQ ID NO: 759885 - RNA, 64 nt, hsa
gaucaucucugcagguuuccuaggucugaaucugcgaguagaugaaccugcagcaagcagcguu

SEQ ID NO: 759886 - RNA, 64 nt, hsa
acacaucaauuaaaggagacaaaaagaggcagagcgaguagagagcagcccucauucaccaccu

SEQ ID NO: 759887 - RNA, 64 nt, hsa
gcuauuuuguaaaccgcugagguauggauaggaacgaguagaucagaccucuugaaaaugcuua

SEQ ID NO: 759888 - RNA, 64 nt, hsa
gggcaaagucuacuggcgccucaaccagcagcuucgaguagagaaaggcuaucccagaaauauu

SEQ ID NO: 759889 - RNA, 64 nt, hsa
cuaacaguucacuugcaguggaagauacuuggaccgaguagaggcauuuaggaacuugggggcu

SEQ ID NO: 759890 - RNA, 64 nt, hsa
ugcaacuuacuaauacuuuauuaauggggagggacgaguagaugguaaaaagaaggaaaaggag

SEQ ID NO: 759891 - RNA, 64 nt, hsa
ccugaucgcaguaaagugguccuugguaacugcucgaguagaacaugucugcauccgccaauag

SEQ ID NO: 759892 - RNA, 64 nt, hsa
guagagacagaucuguuuuaagcaguuggggguucgaguagaucucauggguacaggaggccag

SEQ ID NO: 759893 - RNA, 64 nt, hsa
ggcuguggugauggaucugcuccggcaguaccugcgaguagagacacaauuccagaaugguaag

SEQ ID NO: 759894 - RNA, 64 nt, hsa
aacgcuggagcaaucuccuuggaaggauucagcacgaguagaugguaaacauuuaaaggggaaa

SEQ ID NO: 759895 - RNA, 64 nt, hsa
ggcaggaauucuauuuucgggagaugucuauugccgaguagaguaauauauacccagaguaugu

SEQ ID NO: 759896 - RNA, 64 nt, hsa
uaguaccuugccacucuacccccaacacgucacccgaguagaagcugggcaaggcccuaccauc

SEQ ID NO: 759897 - RNA, 64 nt, hsa
ugguugcuaagaccugaaucccauauugagaucucgaguagaauccuuggugugguuucuggug

SEQ ID NO: 759898 - RNA, 64 nt, hsa
cgagcaucagcuacugcggugucagaucacuucucgaguagaggucugccuagugagugagcag

SEQ ID NO: 759899 - RNA, 64 nt, hsa
gggcaccacaguguuuccaagagcaagcuggauccgaguagauucccuagggcuuguuggagga

SEQ ID NO: 759900 - RNA, 62 nt, hsa
aggaggccacaucacuagcaguagggagaacaagaugucauuuguguucaguguaagcugag

SEQ ID NO: 759901 - RNA, 62 nt, hsa
ucuagcccucacaguaacagagcuaagaauucagaugucaggaagucugugaaucuugaugg

SEQ ID NO: 759902 - RNA, 62 nt, hsa
ucccagacagcagugugagggugcagggaccaagaugucaagcuggccguggagucgagcug

SEQ ID NO: 759903 - RNA, 62 nt, hsa
gugggcccuggcucugucacuaaauggcagugagaugucagacaaauucauucccuucucuc

SEQ ID NO: 759904 - RNA, 62 nt, hsa
uuccauaauaaacuguuaggugcucuugaagaagaugucauggcauugccucagcaccccag

SEQ ID NO: 759905 - RNA, 62 nt, hsa
agaaggcaaggaccaauguuugaacguguuucagaugucauguguuuaguuuuuauaugugu

SEQ ID NO: 759906 - RNA, 62 nt, hsa
uagguauaaaaggugacucagaguagagaguaagaugucagcaaauagacaauaagauguca

SEQ ID NO: 759907 - RNA, 62 nt, hsa
guagagaguaagaugucagcaaauagacaauaagaugucagcaaaagugccucaaauuuuaa

SEQ ID NO: 759908 - RNA, 62 nt, hsa
ucaauugcaaugggccacauaccuagaucuccagaugucauuuccccucucuuauuuuaagu

SEQ ID NO: 759909 - RNA, 62 nt, hsa
uuagauaaugacacaaucaaauauaaauugcaagaugucacaggugugaugaagggagagua

SEQ ID NO: 759910 - RNA, 62 nt, hsa
uuauugaggagucucagagcaaggugcguucuagaugucauccuaaaaaacacuucauauau

SEQ ID NO: 759911 - RNA, 62 nt, hsa
uagaaugcuuaaaugugcuguaaaacuauuguagaugucacuggauuuuaccaaguaauauc

SEQ ID NO: 759912 - RNA, 62 nt, hsa
aacuccaucuuagugaauuuuaaauuauccagagaugucaaacugccaaauaaaaauauuuc

SEQ ID NO: 759913 - RNA, 62 nt, hsa
gaugggggccagguuccgccacagaacaucuuagaugucagccuugaccucacuuagcaggg

SEQ ID NO: 759914 - RNA, 62 nt, hsa
ccucucuauuaauauuaaaacucugggccuucagaugucacccuaauccacuucccuaagac

SEQ ID NO: 759915 - RNA, 62 nt, hsa
uccugugagucauuggcuggguucugauugcuagaugucacacccaccagcaucaccaaagu

SEQ ID NO: 759916 - RNA, 62 nt, hsa
ucguccucccuuucucuaagaggccaucucuaagaugucagauguagaggagagagagcgag

SEQ ID NO: 759917 - RNA, 62 nt, hsa
uguguugaguggaaaaaaaucaguuuuuguaaagaugucaguaacauuccacaucguccucc

SEQ ID NO: 759918 - RNA, 64 nt, hsa; identical to SEQ ID NO: 195961

SEQ ID NO: 759919 - RNA, 64 nt, hsa; identical to SEQ ID NO: 195962

SEQ ID NO: 759920 - RNA, 64 nt, hsa; identical to SEQ ID NO: 195963

SEQ ID NO: 759921 - RNA, 64 nt, hsa; identical to SEQ ID NO: 195964

SEQ ID NO: 759922 - RNA, 64 nt, hsa; identical to SEQ ID NO: 195965

SEQ ID NO: 759923 - RNA, 64 nt, hsa; identical to SEQ ID NO: 195966

SEQ ID NO: 759924 - RNA, 64 nt, hsa; identical to SEQ ID NO: 195967

SEQ ID NO: 759925 - RNA, 64 nt, hsa; identical to SEQ ID NO: 195968

SEQ ID NO: 759926 - RNA, 64 nt, hsa; identical to SEQ ID NO: 195969

SEQ ID NO: 759927 - RNA, 64 nt, hsa; identical to SEQ ID NO: 195970

SEQ ID NO: 759928 - RNA, 64 nt, hsa; identical to SEQ ID NO: 195971

SEQ ID NO: 759929 - RNA, 64 nt, hsa; identical to SEQ ID NO: 195972

SEQ ID NO: 759930 - RNA, 64 nt, hsa; identical to SEQ ID NO: 195973

SEQ ID NO: 759931 - RNA, 64 nt, hsa; identical to SEQ ID NO: 195974

SEQ ID NO: 759932 - RNA, 64 nt, hsa; identical to SEQ ID NO: 195975

SEQ ID NO: 759933 - RNA, 64 nt, hsa; identical to SEQ ID NO: 195976

SEQ ID NO: 759934 - RNA, 64 nt, hsa; identical to SEQ ID NO: 195977

SEQ ID NO: 759935 - RNA, 64 nt, hsa; identical to SEQ ID NO: 195978

SEQ ID NO: 759936 - RNA, 64 nt, hsa; identical to SEQ ID NO: 195979

SEQ ID NO: 759937 - RNA, 64 nt, hsa; identical to SEQ ID NO: 195980

SEQ ID NO: 759938 - RNA, 64 nt, hsa; identical to SEQ ID NO: 195981

SEQ ID NO: 759939 - RNA, 64 nt, hsa; identical to SEQ ID NO: 195982

SEQ ID NO: 759940 - RNA, 64 nt, hsa; identical to SEQ ID NO: 195983

SEQ ID NO: 759941 - RNA, 64 nt, hsa; identical to SEQ ID NO: 195984

SEQ ID NO: 759942 - RNA, 64 nt, hsa; identical to SEQ ID NO: 195985

SEQ ID NO: 759943 - RNA, 64 nt, hsa; identical to SEQ ID NO: 195986

SEQ ID NO: 759944 - RNA, 64 nt, hsa; identical to SEQ ID NO: 195987

SEQ ID NO: 759945 - RNA, 64 nt, hsa
gucaaaaggcaggugcuagacagucuagaccaggguuucucaaacucguacuugacauuugggg

SEQ ID NO: 759946 - RNA, 64 nt, hsa
acuuaaauuuaaguuaauuaagauuaaaagcucaguuucucagucacauuagucauucaagugu

SEQ ID NO: 759947 - RNA, 64 nt, hsa
uacaacuuuccacaacuuguuuuuguacuuuaagguuucucaauuagaauauuucuaguugagc

SEQ ID NO: 759948 - RNA, 64 nt, hsa
aggacuuuguaagucagcauaaaaaugaaaaguuguuucucaguuguuuuugcuuuuaacuuug

SEQ ID NO: 759949 - RNA, 64 nt, hsa
gccagugaggccccaccacaucggugugaguuagguuucucaucuggagcuguuucucaggcau

SEQ ID NO: 759950 - RNA, 64 nt, hsa
acaucggugugaguuagguuucucaucuggagcuguuucucaggcauucuucccaacccucuuc

SEQ ID NO: 759951 - RNA, 64 nt, hsa
gggcccuaacuagaguucuagaguuucugauucuguuucucaguaguccuuuuagaggcuugcu

SEQ ID NO: 759952 - RNA, 64 nt, hsa
uugucaaaucaguuacuguucaggggauccuucuguuucucacggggugaaacaugucuuuagu

SEQ ID NO: 759953 - RNA, 64 nt, hsa
auuuuuuccgaggaugaacaggggacaucuuuagguuucucaacucuugcuuugguguuugccg

SEQ ID NO: 759954 - RNA, 64 nt, hsa
ccgggcgaccugggacucagcaccaacggcugaaguuucucagcugggcucugaccuggggucu

SEQ ID NO: 759955 - RNA, 64 nt, hsa
ugaagaguuugcucuuguaucccuauaguccaagguuucucaaucugcacaauugacauuuuug

SEQ ID NO: 759956 - RNA, 64 nt, hsa
ccuucgcugacuucaccauuccucaaaccuguaaguuucucacuucuuccaaauuggcuuuggc

SEQ ID NO: 759957 - RNA, 64 nt, hsa
cuuuaaccucuaguuuuccauacauccuuuguuuguuucucauuuuauuuuccuugacccauuu

SEQ ID NO: 759958 - RNA, 64 nt, hsa
ucauuaaauaugaaauggauauaugcuaggcaguguuucucaaaaucuccauagaucgccugca

SEQ ID NO: 759959 - RNA, 64 nt, hsa
ccgucacacacgccccuuuuguguuuugguucaaguuucucagagccccucagagcuucuacau

SEQ ID NO: 759960 - RNA, 64 nt, hsa
cccuugauauuuuaagcauuuucccaugucaugaguuucucagaaacauguuuuuaacaauugu

SEQ ID NO: 759961 - RNA, 64 nt, hsa
ccacaggaagggaaguagacauuguaugcuuaugguuucucauuaugaaggugcagcuuguagg

SEQ ID NO: 759962 - RNA, 64 nt, hsa
cugucuucaaccuacuuuuccuuuucucuuuuuuguuucucauccucucugugccaccucucca

SEQ ID NO: 759963 - RNA, 64 nt, hsa
aagugagcaugcacggaccucuucccccuguccuguuucucacccagcaccuggggagaucggu

SEQ ID NO: 759964 - RNA, 64 nt, hsa
ucccuguuuguagcaagacucugaugauaauucuguuucucaucugcccauucaguauuuuguu

SEQ ID NO: 759965 - RNA, 64 nt, hsa
cuuaucacugcauugugaagaggaggaaaagugaaucacggagagagaaaggaaaggauagaau

SEQ ID NO: 759966 - RNA, 64 nt, hsa
auccugcaguguuuaaggaacucuuuuuuuguaaaucacggacaccucaauuagcaagaacuga

SEQ ID NO: 759967 - RNA, 64 nt, hsa
guccaaguaagcagucuggcuggaauaaggcagcaucacggaaauucuguaaggacugacacag

SEQ ID NO: 759968 - RNA, 64 nt, hsa
gagguuuaagugcaacaccaggcugugucuuucuaucacggauuuccacccggacacguggaac

SEQ ID NO: 759969 - RNA, 64 nt, hsa
ggccauugguucucaaacuuaaggaaggaucagcaucacggaaggucuugucaaaagagugcug

SEQ ID NO: 759970 - RNA, 64 nt, hsa
uacucaagcaauaguugaagggaaggugcauauuaucacggaugcaauuuauguugugugccag

SEQ ID NO: 759971 - RNA, 64 nt, hsa
guauauuaaagcaccaaauucauguacagcaugcaucacggaucaauagacuguacuuauuuuc

SEQ ID NO: 759972 - RNA, 64 nt, hsa
aggacuuggcaacaugauguuugacuguaaucucaucacggauauguaugaauuuuuacagguu

SEQ ID NO: 759973 - RNA, 64 nt, hsa
augacucugagaaguugaauugcuugaagaguucaucacggaaauucaagaaacuuuacuucaa

SEQ ID NO: 759974 - RNA, 64 nt, hsa
cugccacugcccaccgccucuucuccaucugagaaucacggagagguguagauaaucuagaggc

SEQ ID NO: 759975 - RNA, 64 nt, hsa
uugagguacugcuauauaaauauucacucacauuaucacggaauuuauguauaguuucucuaau

SEQ ID NO: 759976 - RNA, 64 nt, hsa
cgucacugaguguggcugggcuacaucauagcucaucacggagcuacgacuuuggguacugcgg

SEQ ID NO: 759977 - RNA, 64 nt, hsa
aucugggaagaguggagaaauuugccacuugacgaucacggauuagcuagcaccuuuaagcccu

SEQ ID NO: 759978 - RNA, 64 nt, hsa
acagggagcagagacugcuuuaaucccugcugacaucacggaaaagcaacagagccuuuucaac

SEQ ID NO: 759979 - RNA, 64 nt, hsa
cuaucuauugccuuuguaaaaaacagagaaaacgaucacggacagguaugcacugguaacaugc

SEQ ID NO: 759980 - RNA, 64 nt, hsa
ucucgaggccacacucgcucggcaggauuaugcgaucacggaucagucagagcagggucaggag

SEQ ID NO: 759981 - RNA, 64 nt, hsa
guuuuauacuacuuccauaaaacaggauuggugaaucacggacuucuagucaaccuacagcuua

SEQ ID NO: 759982 - RNA, 64 nt, hsa
agauuagaaaucgcgacacauuuguagucauuguaucacggauuacaaugaacgcagugcagag

SEQ ID NO: 759983 - RNA, 64 nt, hsa
accacccgagccugggagccagcgucccagccuaaucacggaucugcugccucccagcugucuu

SEQ ID NO: 759984 - RNA, 64 nt, hsa
auguguuuuagauugauuucccuguuucagggaaaucacggacaguaguuucaguucugauggu

SEQ ID NO: 759985 - RNA, 64 nt, hsa
ccuguccccaucaucccugacugaguacucugacaucacggaaaguguugaaccugggacccug

SEQ ID NO: 759986 - RNA, 64 nt, hsa
uaggcucucaacaugacuauagagaccccgugucaucacggagaccuuuguuccugugggaaaa

SEQ ID NO: 759987 - RNA, 64 nt, hsa
guauuucuucaugcuuuccagaguuagagccuugaucacggaacaucauugugugcagaagaau

SEQ ID NO: 759988 - RNA, 64 nt, hsa
gaaaugccaaaccgaaggauuucugaggaccuaaaucacggagcaucaaucuuacaaaguguug

SEQ ID NO: 759989 - RNA, 64 nt, hsa
ggugagccaggagcccgugcuguucgcccgcuccaucacggauaacaucuccuacggccugccc

SEQ ID NO: 759990 - RNA, 64 nt, hsa
ccuaauccugagucgucacccuuggauuuuauggaucacggagcugaccaucuuuaccuggucc

SEQ ID NO: 759991 - RNA, 64 nt, hsa
aaaaaaauggaggugguagaugccacagagaggcaucacggaagccuuaacagcaggaaacaga

SEQ ID NO: 759992 - RNA, 64 nt, hsa
caagcaaucgugauuguaggucaaguaucgcgccaucacggaagguguaaguauauguagguuu

SEQ ID NO: 759993 - RNA, 64 nt, hsa
caggucaucuuguagaacuccagcuuuguugaaaaucacggaccucagcuacaucauacacuga

SEQ ID NO: 759994 - RNA, 64 nt, hsa
gggugccaguccaucucaagugccauauucugugaucacggauguuggcucccccucgcccuau

SEQ ID NO: 759995 - RNA, 64 nt, hsa
agacccuucacaagcaaaaucagccagcacuuugaucacggacuucccagccucuaggacugug

SEQ ID NO: 759996 - RNA, 64 nt, hsa
gacccacacagguccacccacgcugggggcuguaaucacggagggaaguggcugcccccuuaac

SEQ ID NO: 759997 - RNA, 64 nt, hsa
agaaguuguuuggaccuuagagccauuguccacaaucacggaugguucucaagaguugauugua

SEQ ID NO: 759998 - RNA, 64 nt, hsa
ugacaugccauccauucugccgucguggaauuaaaucacggauggcagauuggagggucgccug

SEQ ID NO: 759999 - RNA, 64 nt, hsa
cguggggcccacugcucguggacugugcuggugcaucacggauggugcaugggcucgccguguc

SEQ ID NO: 760000 - RNA, 64 nt, hsa
agggcauuucaugaaccaucucaggcacuucugcaucacggaagaccuggcccucccagccguc

SEQ ID NO: 760001 - RNA, 64 nt, hsa
agccggaguggcggggcacgcugccgccuuccccaucacggaggguccagacuguccacucggg

SEQ ID NO: 760002 - RNA, 64 nt, hsa
uuuccggugaauacgggauugcacuuacucuuucaucacggaaacagaccccccgagagaagcc

SEQ ID NO: 760003 - RNA, 64 nt, hsa
cuaaacauuuuauagaaaauauuucuaaaauuuuaucacggaugaauggauggacuugcucucu

SEQ ID NO: 760004 - RNA, 64 nt, hsa
gugacuauggagccaaugggaugugacuucgcucaucacggacagucauuccuucuccuuucca

SEQ ID NO: 760005 - RNA, 64 nt, hsa
guguugccagacuuaacccagcagacacucugacaucacggagcuucacugaugacagguaacg

SEQ ID NO: 760006 - RNA, 64 nt, hsa
cacauccuaggagggaaaguccaguguaccugucaucacggacgcacuguggucacagacugga

SEQ ID NO: 760007 - RNA, 64 nt, hsa
gauggaagagcaacugaggcacgccaaguucaccaucacggagugcuucauaucagacacguca

SEQ ID NO: 760008 - RNA, 64 nt, hsa
cggcccaccugggagccucagaucccccucuuccaucacggagguaaaguugaggccguggacg

SEQ ID NO: 760009 - RNA, 64 nt, hsa
uguguaauaauaaagaaagauucggcuuuuggcaaucacggacacuuuuuuccccuccaccgaa

SEQ ID NO: 760010 - RNA, 64 nt, hsa
augucuguauguccgugcuuagcuuauucuaucaaucacggaagaggcagucaaggaggaagga

SEQ ID NO: 760011 - RNA, 64 nt, hsa
aauaaaaacuugcugguuuugcggcuugugaggcaucacggaaccuaccgaugugugaugucuc

SEQ ID NO: 760012 - RNA, 64 nt, hsa
uuuucggaagcagcauucacuguggauuuggaacaucacggacguucuucaucuugagucauca

SEQ ID NO: 760013 - RNA, 64 nt, hsa; identical to SEQ ID NO: 656770

SEQ ID NO: 760014 - RNA, 64 nt, hsa; identical to SEQ ID NO: 656771

SEQ ID NO: 760015 - RNA, 64 nt, hsa; identical to SEQ ID NO: 656772

SEQ ID NO: 760016 - RNA, 64 nt, hsa; identical to SEQ ID NO: 656773

SEQ ID NO: 760017 - RNA, 64 nt, hsa; identical to SEQ ID NO: 656774

SEQ ID NO: 760018 - RNA, 64 nt, hsa; identical to SEQ ID NO: 656775

SEQ ID NO: 760019 - RNA, 64 nt, hsa; identical to SEQ ID NO: 264152

SEQ ID NO: 760020 - RNA, 64 nt, hsa; identical to SEQ ID NO: 264153

SEQ ID NO: 760021 - RNA, 64 nt, hsa; identical to SEQ ID NO: 264154

SEQ ID NO: 760022 - RNA, 64 nt, hsa; identical to SEQ ID NO: 264155

SEQ ID NO: 760023 - RNA, 64 nt, hsa; identical to SEQ ID NO: 264156

SEQ ID NO: 760024 - RNA, 64 nt, hsa; identical to SEQ ID NO: 264157

SEQ ID NO: 760025 - RNA, 64 nt, hsa; identical to SEQ ID NO: 264158

SEQ ID NO: 760026 - RNA, 64 nt, hsa; identical to SEQ ID NO: 264159

SEQ ID NO: 760027 - RNA, 64 nt, hsa; identical to SEQ ID NO: 264160

SEQ ID NO: 760028 - RNA, 64 nt, hsa; identical to SEQ ID NO: 264161

SEQ ID NO: 760029 - RNA, 64 nt, hsa; identical to SEQ ID NO: 264162

SEQ ID NO: 760030 - RNA, 64 nt, hsa; identical to SEQ ID NO: 264163

SEQ ID NO: 760031 - RNA, 64 nt, hsa; identical to SEQ ID NO: 264164

SEQ ID NO: 760032 - RNA, 64 nt, hsa; identical to SEQ ID NO: 264165

SEQ ID NO: 760033 - RNA, 64 nt, hsa; identical to SEQ ID NO: 264166

SEQ ID NO: 760034 - RNA, 64 nt, hsa; identical to SEQ ID NO: 264167

SEQ ID NO: 760035 - RNA, 64 nt, hsa; identical to SEQ ID NO: 264168

SEQ ID NO: 760036 - RNA, 64 nt, hsa; identical to SEQ ID NO: 264169

SEQ ID NO: 760037 - RNA, 64 nt, hsa; identical to SEQ ID NO: 264170

SEQ ID NO: 760038 - RNA, 64 nt, hsa; identical to SEQ ID NO: 264171

SEQ ID NO: 760039 - RNA, 64 nt, hsa
auuaccucagcgggagggagcagagcugggacaggcagcuaaaaugagcagcucccaagaauca

SEQ ID NO: 760040 - RNA, 64 nt, hsa
cacgguucuguugacggaugcugacuuuggagaggcagcuaagcagaagucccugacggucacu

SEQ ID NO: 760041 - RNA, 64 nt, hsa; identical to SEQ ID NO: 86383

SEQ ID NO: 760042 - RNA, 64 nt, hsa; identical to SEQ ID NO: 86384

SEQ ID NO: 760043 - RNA, 64 nt, hsa; identical to SEQ ID NO: 86385

SEQ ID NO: 760044 - RNA, 64 nt, hsa; identical to SEQ ID NO: 86386

SEQ ID NO: 760045 - RNA, 64 nt, hsa; identical to SEQ ID NO: 86387

SEQ ID NO: 760046 - RNA, 64 nt, hsa; identical to SEQ ID NO: 86388

SEQ ID NO: 760047 - RNA, 64 nt, hsa; identical to SEQ ID NO: 86389

SEQ ID NO: 760048 - RNA, 64 nt, hsa; identical to SEQ ID NO: 86390

SEQ ID NO: 760049 - RNA, 64 nt, hsa; identical to SEQ ID NO: 86391

SEQ ID NO: 760050 - RNA, 64 nt, hsa; identical to SEQ ID NO: 86392

SEQ ID NO: 760051 - RNA, 64 nt, hsa; identical to SEQ ID NO: 86393

SEQ ID NO: 760052 - RNA, 64 nt, hsa; identical to SEQ ID NO: 86394

SEQ ID NO: 760053 - RNA, 61 nt, hsa; identical to SEQ ID NO: 86395

SEQ ID NO: 760054 - RNA, 64 nt, hsa; identical to SEQ ID NO: 86396

SEQ ID NO: 760055 - RNA, 64 nt, hsa; identical to SEQ ID NO: 86397

SEQ ID NO: 760056 - RNA, 64 nt, hsa; identical to SEQ ID NO: 86398

SEQ ID NO: 760057 - RNA, 64 nt, hsa; identical to SEQ ID NO: 86399

SEQ ID NO: 760058 - RNA, 64 nt, hsa; identical to SEQ ID NO: 86400

SEQ ID NO: 760059 - RNA, 64 nt, hsa; identical to SEQ ID NO: 86401

SEQ ID NO: 760060 - RNA, 64 nt, hsa; identical to SEQ ID NO: 86402

SEQ ID NO: 760061 - RNA, 64 nt, hsa; identical to SEQ ID NO: 86403

SEQ ID NO: 760062 - RNA, 64 nt, hsa; identical to SEQ ID NO: 86404

SEQ ID NO: 760063 - RNA, 64 nt, hsa; identical to SEQ ID NO: 86405

SEQ ID NO: 760064 - RNA, 64 nt, hsa; identical to SEQ ID NO: 86406

SEQ ID NO: 760065 - RNA, 64 nt, hsa; identical to SEQ ID NO: 86407

SEQ ID NO: 760066 - RNA, 64 nt, hsa; identical to SEQ ID NO: 86408

SEQ ID NO: 760067 - RNA, 64 nt, hsa; identical to SEQ ID NO: 86409

SEQ ID NO: 760068 - RNA, 64 nt, hsa; identical to SEQ ID NO: 86410

SEQ ID NO: 760069 - RNA, 64 nt, hsa; identical to SEQ ID NO: 86411

SEQ ID NO: 760070 - RNA, 64 nt, hsa; identical to SEQ ID NO: 86412

SEQ ID NO: 760071 - RNA, 64 nt, hsa; identical to SEQ ID NO: 86413

SEQ ID NO: 760072 - RNA, 64 nt, hsa; identical to SEQ ID NO: 86414

SEQ ID NO: 760073 - RNA, 64 nt, hsa; identical to SEQ ID NO: 86415

SEQ ID NO: 760074 - RNA, 64 nt, hsa; identical to SEQ ID NO: 86416

SEQ ID NO: 760075 - RNA, 64 nt, hsa; identical to SEQ ID NO: 86417

SEQ ID NO: 760076 - RNA, 64 nt, hsa; identical to SEQ ID NO: 86418

SEQ ID NO: 760077 - RNA, 64 nt, hsa; identical to SEQ ID NO: 86419

SEQ ID NO: 760078 - RNA, 64 nt, hsa; identical to SEQ ID NO: 86420

SEQ ID NO: 760079 - RNA, 64 nt, hsa; identical to SEQ ID NO: 86421

SEQ ID NO: 760080 - RNA, 64 nt, hsa; identical to SEQ ID NO: 86422

SEQ ID NO: 760081 - RNA, 64 nt, hsa; identical to SEQ ID NO: 86423

SEQ ID NO: 760082 - RNA, 64 nt, hsa; identical to SEQ ID NO: 86424

SEQ ID NO: 760083 - RNA, 64 nt, hsa; identical to SEQ ID NO: 86425

SEQ ID NO: 760084 - RNA, 64 nt, hsa; identical to SEQ ID NO: 86426

SEQ ID NO: 760085 - RNA, 64 nt, hsa; identical to SEQ ID NO: 86427

SEQ ID NO: 760086 - RNA, 64 nt, hsa; identical to SEQ ID NO: 86428

SEQ ID NO: 760087 - RNA, 64 nt, hsa; identical to SEQ ID NO: 86429

SEQ ID NO: 760088 - RNA, 64 nt, hsa; identical to SEQ ID NO: 86430

SEQ ID NO: 760089 - RNA, 64 nt, hsa; identical to SEQ ID NO: 86431

SEQ ID NO: 760090 - RNA, 64 nt, hsa; identical to SEQ ID NO: 86432

SEQ ID NO: 760091 - RNA, 64 nt, hsa; identical to SEQ ID NO: 86433

SEQ ID NO: 760092 - RNA, 64 nt, hsa; identical to SEQ ID NO: 86434

SEQ ID NO: 760093 - RNA, 64 nt, hsa; identical to SEQ ID NO: 86435

SEQ ID NO: 760094 - RNA, 64 nt, hsa; identical to SEQ ID NO: 86436

SEQ ID NO: 760095 - RNA, 64 nt, hsa; identical to SEQ ID NO: 86437

SEQ ID NO: 760096 - RNA, 64 nt, hsa; identical to SEQ ID NO: 86438

SEQ ID NO: 760097 - RNA, 64 nt, hsa; identical to SEQ ID NO: 86439

SEQ ID NO: 760098 - RNA, 64 nt, hsa; identical to SEQ ID NO: 86440

SEQ ID NO: 760099 - RNA, 64 nt, hsa; identical to SEQ ID NO: 86441

SEQ ID NO: 760100 - RNA, 64 nt, hsa; identical to SEQ ID NO: 86442

SEQ ID NO: 760101 - RNA, 64 nt, hsa; identical to SEQ ID NO: 86443

SEQ ID NO: 760102 - RNA, 64 nt, hsa; identical to SEQ ID NO: 86444

SEQ ID NO: 760103 - RNA, 64 nt, hsa; identical to SEQ ID NO: 86445

SEQ ID NO: 760104 - RNA, 60 nt, hsa; identical to SEQ ID NO: 86446

SEQ ID NO: 760105 - RNA, 64 nt, hsa; identical to SEQ ID NO: 86447

SEQ ID NO: 760106 - RNA, 64 nt, hsa; identical to SEQ ID NO: 86448

SEQ ID NO: 760107 - RNA, 64 nt, hsa; identical to SEQ ID NO: 86449

SEQ ID NO: 760108 - RNA, 64 nt, hsa; identical to SEQ ID NO: 86450

SEQ ID NO: 760109 - RNA, 64 nt, hsa; identical to SEQ ID NO: 86451

SEQ ID NO: 760110 - RNA, 64 nt, hsa; identical to SEQ ID NO: 86452

SEQ ID NO: 760111 - RNA, 64 nt, hsa; identical to SEQ ID NO: 86453

SEQ ID NO: 760112 - RNA, 64 nt, hsa; identical to SEQ ID NO: 86454

SEQ ID NO: 760113 - RNA, 64 nt, hsa; identical to SEQ ID NO: 86455

SEQ ID NO: 760114 - RNA, 64 nt, hsa; identical to SEQ ID NO: 86456

SEQ ID NO: 760115 - RNA, 64 nt, hsa; identical to SEQ ID NO: 86457

SEQ ID NO: 760116 - RNA, 64 nt, hsa; identical to SEQ ID NO: 86458

SEQ ID NO: 760117 - RNA, 64 nt, hsa; identical to SEQ ID NO: 86459

SEQ ID NO: 760118 - RNA, 64 nt, hsa; identical to SEQ ID NO: 86460

SEQ ID NO: 760119 - RNA, 64 nt, hsa; identical to SEQ ID NO: 86461

SEQ ID NO: 760120 - RNA, 55 nt, hsa; identical to SEQ ID NO: 86462

SEQ ID NO: 760121 - RNA, 64 nt, hsa; identical to SEQ ID NO: 86463

SEQ ID NO: 760122 - RNA, 64 nt, hsa; identical to SEQ ID NO: 86464

SEQ ID NO: 760123 - RNA, 64 nt, hsa; identical to SEQ ID NO: 86465

SEQ ID NO: 760124 - RNA, 64 nt, hsa; identical to SEQ ID NO: 86466

SEQ ID NO: 760125 - RNA, 64 nt, hsa; identical to SEQ ID NO: 86467

SEQ ID NO: 760126 - RNA, 64 nt, hsa; identical to SEQ ID NO: 86468

SEQ ID NO: 760127 - RNA, 64 nt, hsa; identical to SEQ ID NO: 86469

SEQ ID NO: 760128 - RNA, 64 nt, hsa; identical to SEQ ID NO: 86470

SEQ ID NO: 760129 - RNA, 64 nt, hsa; identical to SEQ ID NO: 86471

SEQ ID NO: 760130 - RNA, 64 nt, hsa; identical to SEQ ID NO: 86472

SEQ ID NO: 760131 - RNA, 64 nt, hsa; identical to SEQ ID NO: 86473

SEQ ID NO: 760132 - RNA, 64 nt, hsa; identical to SEQ ID NO: 86474

SEQ ID NO: 760133 - RNA, 64 nt, hsa; identical to SEQ ID NO: 86475

SEQ ID NO: 760134 - RNA, 64 nt, hsa; identical to SEQ ID NO: 86476

SEQ ID NO: 760135 - RNA, 64 nt, hsa; identical to SEQ ID NO: 86477

SEQ ID NO: 760136 - RNA, 64 nt, hsa; identical to SEQ ID NO: 86478

SEQ ID NO: 760137 - RNA, 64 nt, hsa; identical to SEQ ID NO: 86479

SEQ ID NO: 760138 - RNA, 64 nt, hsa; identical to SEQ ID NO: 86480

SEQ ID NO: 760139 - RNA, 64 nt, hsa; identical to SEQ ID NO: 86481

SEQ ID NO: 760140 - RNA, 64 nt, hsa; identical to SEQ ID NO: 86482

SEQ ID NO: 760141 - RNA, 64 nt, hsa; identical to SEQ ID NO: 86483

SEQ ID NO: 760142 - RNA, 64 nt, hsa; identical to SEQ ID NO: 86484

SEQ ID NO: 760143 - RNA, 64 nt, hsa; identical to SEQ ID NO: 86485

SEQ ID NO: 760144 - RNA, 64 nt, hsa; identical to SEQ ID NO: 86486

SEQ ID NO: 760145 - RNA, 64 nt, hsa; identical to SEQ ID NO: 86487

SEQ ID NO: 760146 - RNA, 64 nt, hsa; identical to SEQ ID NO: 86488

SEQ ID NO: 760147 - RNA, 64 nt, hsa; identical to SEQ ID NO: 86489

SEQ ID NO: 760148 - RNA, 64 nt, hsa; identical to SEQ ID NO: 86490

SEQ ID NO: 760149 - RNA, 64 nt, hsa; identical to SEQ ID NO: 86491

SEQ ID NO: 760150 - RNA, 64 nt, hsa; identical to SEQ ID NO: 86492

SEQ ID NO: 760151 - RNA, 64 nt, hsa; identical to SEQ ID NO: 86493

SEQ ID NO: 760152 - RNA, 51 nt, hsa; identical to SEQ ID NO: 86494

SEQ ID NO: 760153 - RNA, 64 nt, hsa; identical to SEQ ID NO: 86495

SEQ ID NO: 760154 - RNA, 64 nt, hsa; identical to SEQ ID NO: 86496

SEQ ID NO: 760155 - RNA, 64 nt, hsa; identical to SEQ ID NO: 86497

SEQ ID NO: 760156 - RNA, 64 nt, hsa; identical to SEQ ID NO: 86498

SEQ ID NO: 760157 - RNA, 64 nt, hsa; identical to SEQ ID NO: 86499

SEQ ID NO: 760158 - RNA, 64 nt, hsa; identical to SEQ ID NO: 86500

SEQ ID NO: 760159 - RNA, 64 nt, hsa; identical to SEQ ID NO: 86501

SEQ ID NO: 760160 - RNA, 64 nt, hsa; identical to SEQ ID NO: 86502

SEQ ID NO: 760161 - RNA, 64 nt, hsa; identical to SEQ ID NO: 86503

SEQ ID NO: 760162 - RNA, 64 nt, hsa; identical to SEQ ID NO: 86504

SEQ ID NO: 760163 - RNA, 64 nt, hsa; identical to SEQ ID NO: 86505

SEQ ID NO: 760164 - RNA, 64 nt, hsa; identical to SEQ ID NO: 86506

SEQ ID NO: 760165 - RNA, 64 nt, hsa; identical to SEQ ID NO: 86507

SEQ ID NO: 760166 - RNA, 64 nt, hsa; identical to SEQ ID NO: 86508

SEQ ID NO: 760167 - RNA, 64 nt, hsa; identical to SEQ ID NO: 86509

SEQ ID NO: 760168 - RNA, 64 nt, hsa; identical to SEQ ID NO: 86510

SEQ ID NO: 760169 - RNA, 64 nt, hsa; identical to SEQ ID NO: 86511

SEQ ID NO: 760170 - RNA, 64 nt, hsa; identical to SEQ ID NO: 86512

SEQ ID NO: 760171 - RNA, 64 nt, hsa; identical to SEQ ID NO: 86513

SEQ ID NO: 760172 - RNA, 64 nt, hsa; identical to SEQ ID NO: 86514

SEQ ID NO: 760173 - RNA, 64 nt, hsa; identical to SEQ ID NO: 86515

SEQ ID NO: 760174 - RNA, 64 nt, hsa; identical to SEQ ID NO: 86516

SEQ ID NO: 760175 - RNA, 64 nt, hsa; identical to SEQ ID NO: 86517

SEQ ID NO: 760176 - RNA, 64 nt, hsa; identical to SEQ ID NO: 86518

SEQ ID NO: 760177 - RNA, 64 nt, hsa; identical to SEQ ID NO: 86519

SEQ ID NO: 760178 - RNA, 64 nt, hsa; identical to SEQ ID NO: 86520

SEQ ID NO: 760179 - RNA, 64 nt, hsa; identical to SEQ ID NO: 86521

SEQ ID NO: 760180 - RNA, 64 nt, hsa; identical to SEQ ID NO: 86522

SEQ ID NO: 760181 - RNA, 64 nt, hsa; identical to SEQ ID NO: 86523

SEQ ID NO: 760182 - RNA, 64 nt, hsa; identical to SEQ ID NO: 86524

SEQ ID NO: 760183 - RNA, 64 nt, hsa; identical to SEQ ID NO: 86525

SEQ ID NO: 760184 - RNA, 64 nt, hsa
gcgugaaucccgagggagccgguggcauacaccguuagcuuaaccuuagcuuaaacuagcugaa

SEQ ID NO: 760185 - RNA, 64 nt, hsa
gagggagccgguggcauacaccguuagcuuaaccuuagcuuaaacuagcugaaggcuccugugc

SEQ ID NO: 760186 - RNA, 64 nt, hsa
aagcacauugguauuguauaaagguauagagcacuuagcuuacaaucuuuaaagguuucucugc

SEQ ID NO: 760187 - RNA, 64 nt, hsa
ucagaccaacugaggagcuuuccuuguuaacaauuuagcuuaucuuucuguuuccuuuauuuuu

SEQ ID NO: 760188 - RNA, 64 nt, hsa
caccuacccacaugcacucgugugagacaaggcccauagguauggccccccccuucccccuccc

SEQ ID NO: 760189 - RNA, 64 nt, hsa
gguuccagugagcgguguguugagccuaguagagcauagguacuugggguugccaaaaccccag

SEQ ID NO: 760190 - RNA, 64 nt, hsa
ccagcaggucccuuuuugucucucaugggccuagcauagguaugagccagggauccuuuccugg

SEQ ID NO: 760191 - RNA, 64 nt, hsa
uuacaguaauccacugagauguaguuuagucaaacauagguauaugaacuguuaaucuuggugg

SEQ ID NO: 760192 - RNA, 64 nt, hsa
cgcugcagccagcaguuguaaaauuguuaguaaacauagguauaauuaccagauaguuauauua

SEQ ID NO: 760193 - RNA, 64 nt, hsa
uguagaaucuaaguuaaacuuacuauuuauaaugcauagguaaccauuaacuauguacauauaa

SEQ ID NO: 760194 - RNA, 64 nt, hsa
cccacagaaggaggaaguggaagggacaggagcacauagguagaugccaaguuaugcagcuguu

SEQ ID NO: 760195 - RNA, 64 nt, hsa
aguaaccuggacggcucuaaggcuggaaugaccacauagguagguauggugaguucaaccauuu

SEQ ID NO: 760196 - RNA, 64 nt, hsa
cccugcuguuuuacugguguauaggauacuuguacauagguaaccaauguacaugggaggccac

SEQ ID NO: 760197 - RNA, 64 nt, hsa
uuuuagauucagggguauaugugcagguuuguuacauagguaaacugcaugucauggggguuug

SEQ ID NO: 760198 - RNA, 64 nt, hsa
guacaguuaucauuaucaucaucaucgucaucaucauagguaacaguuauaucaagcuuaauau

SEQ ID NO: 760199 - RNA, 64 nt, hsa
uaagcagaccuuauuucucccuacacuuccacuccauagguaaauaaacugggugaagccacac

SEQ ID NO: 760200 - RNA, 64 nt, hsa
aaaaggauuuauugguucauguaacuagaaaguccauagguagugcuggcuccaggugaagacu

SEQ ID NO: 760201 - RNA, 64 nt, hsa
caggggagaaauagcagaggggcuuggagggucacauagguagaugguaaagagaaugaggaga

SEQ ID NO: 760202 - RNA, 64 nt, hsa
cacaucagacuggcaacuguuuuguagcaagagccauagguagccuuacuacuugggccucuuu

SEQ ID NO: 760203 - RNA, 64 nt, hsa
uccuccuauuugccacugggcuguugguuagaagcauagguaacugauuaaguagguaugauac

SEQ ID NO: 760204 - RNA, 64 nt, hsa
cagcaucuguaugauauaguggagcaggugcugacauagguaccagcugacaugaugugucacu

SEQ ID NO: 760205 - RNA, 64 nt, hsa
uauagguauuuuaguacaguacauacuugcauuacauagguacuucaagcaacacaauaaaaag

SEQ ID NO: 760206 - RNA, 64 nt, hsa
guauaccaucuucuauuuccagcuccugauuccccauagguaacaucccuuaggagcgaagagu

SEQ ID NO: 760207 - RNA, 64 nt, hsa
ucuguaauacaaggauucaaaauaugugagggugcauagguauuuuuuacucuaucugugauac

SEQ ID NO: 760208 - RNA, 64 nt, hsa
gguuagggguuaggggcuaguuuuggauuugauucauagguaggagggcuuagauuuuaaggca

SEQ ID NO: 760209 - RNA, 64 nt, hsa
cagcagggcuggcugccacagggcugcccugccucauagguagccauggugagggcuaucugcu

SEQ ID NO: 760210 - RNA, 64 nt, hsa
agaaaauucuaauauaaagcauuucaauaggaugcauagguauauuacguuuuuuaaaugcuuu

SEQ ID NO: 760211 - RNA, 64 nt, hsa
aguauguauauauguguaugcucagauuaacuuccauagguacauaagugaaagaagucucagu

SEQ ID NO: 760212 - RNA, 64 nt, hsa
uuguuauaaagcauuuguuuguuaguaucaaucacauagguagaaagaguuugaguuuuacugu

SEQ ID NO: 760213 - RNA, 64 nt, hsa
ucuuccuuucuucccaaugucuauuaagaucacacauagguaaacuguuacaaauccagaaugg

SEQ ID NO: 760214 - RNA, 64 nt, hsa
gaccaauuuaaaaugcuagggaacaggcuuacaacauagguaaaacucgcaaacacaguucaag

SEQ ID NO: 760215 - RNA, 64 nt, hsa
gcaucaauauauuauguuucuuggcauuguucagcauagguaaugugugcacuuuauguguaca

SEQ ID NO: 760216 - RNA, 64 nt, hsa
uucuuuuauuguucaaucuguuagugagaugugucauagguauuaugucauuaguucaaauucu

SEQ ID NO: 760217 - RNA, 64 nt, hsa
auuuauuccaucuucacuaaaauagaagcaauuccauagguaccauaaaccuauuuuagguacc

SEQ ID NO: 760218 - RNA, 64 nt, hsa
caucauacucagggguuagcuuccaaggucaguacauagguaaaaugggcuauuaggaugaucc

SEQ ID NO: 760219 - RNA, 64 nt, hsa
aggauuuauuugaaaauggugggauucauuggcccauagguacauuggaaaauguauaucucuc

SEQ ID NO: 760220 - RNA, 64 nt, hsa
caauauucagugaccauaguugacuuuuacauuccauagguauuuuauuuuguggcauuuccau

SEQ ID NO: 760221 - RNA, 64 nt, hsa
uauccuuccauuuuggccuccugaguagcuagaccauagguaugcaucaccacacccugcuaau

SEQ ID NO: 760222 - RNA, 64 nt, hsa
uucuguuuuguaaugaccaaaggaaugaggcugacauagguauauauauauauuuuuuuccuuu

SEQ ID NO: 760223 - RNA, 64 nt, hsa
ugaugagccugcauaaagugaagcugcaauguaacauagguaucuuuuucuaaaaacuucaagu

SEQ ID NO: 760224 - RNA, 64 nt, hsa
uucauuaggaacuuuuuuguuugaaugaaugucacauagguauccucaguaacacagaacgaaa

SEQ ID NO: 760225 - RNA, 64 nt, hsa
agcucaagcaggaaguucaacuuccagaauugaucauagguauuucaaaacacaucuuuccugu

SEQ ID NO: 760226 - RNA, 64 nt, hsa
aacaucuuaugauuuagaguaaguugauuguaaccauagguauuuauugauuggaggaagggag

SEQ ID NO: 760227 - RNA, 64 nt, hsa
uggcucaggacggguauggaaacccuucauuccucauagguacugggaaguccauuugcaagcu

SEQ ID NO: 760228 - RNA, 64 nt, hsa
ucaugcugaaugaagcguaggaacuugacaagcccauagguagcuauaguucuuugucaguaua

SEQ ID NO: 760229 - RNA, 64 nt, hsa
uaccuugguaggagggagucaguacuguuggacccauagguagccucaucccugccacuguguu

SEQ ID NO: 760230 - RNA, 64 nt, hsa
ugagaacugaggacauuauggcucucauaaucugcauagguauaaagaggaucauuucuaccua

SEQ ID NO: 760231 - RNA, 64 nt, hsa
aaaaucucaaucuugaaaaucaagcuugaaauuucauagguagaaauauuagcauuuuuauuga

SEQ ID NO: 760232 - RNA, 64 nt, hsa
aagccuugauuggauuuugguuuaggaaaaaucucauagguauaaaagacaacugggaauguug

SEQ ID NO: 760233 - RNA, 64 nt, hsa
uuauuucuuuugugcagaucacuuuuuaaacucacauagguagguaucuuuauaguuguagacu

SEQ ID NO: 760234 - RNA, 64 nt, hsa
uuuuaaguucaaggguacaugugcagguuuguuacauagguaaacuugugucauggggguuuac

SEQ ID NO: 760235 - RNA, 64 nt, hsa
cgucucaaaaaaaaaaaaagaaaauugugcaaagcauagguaaauauuuuucuuuauuaagcuu

SEQ ID NO: 760236 - RNA, 64 nt, hsa
gugagggguuuuggggaguuuggggucaagagagcauagguagguuccaguuacucuucccaca

SEQ ID NO: 760237 - RNA, 64 nt, hsa
ccgugaucacacgucccagguccugagagcgccucauagguagacaguucuuugggacuuuugg

SEQ ID NO: 760238 - RNA, 64 nt, hsa
cuuaaauuguuuugcagucuuuuauguuuauuaucauagguauagguggaccuaaauuccuuau

SEQ ID NO: 760239 - RNA, 64 nt, hsa
ugauauuucaauguuagccucaauuucugaacaccauagguagaauguaaagcuugucugaucg

SEQ ID NO: 760240 - RNA, 64 nt, hsa
gagaugucaagaaguuaaauugaggcuuaaugagcauagguagcuuguccaaggucucaugacc

SEQ ID NO: 760241 - RNA, 64 nt, hsa
uugaaaaugcugcacaucccuuaauagucaucuacauagguaauacugauaaacauuuuguauu

SEQ ID NO: 760242 - RNA, 64 nt, hsa
aguucucuaauauucuuaguaccacaagauaugucauagguaucuuuaaaugaaauucuuagcu

SEQ ID NO: 760243 - RNA, 64 nt, hsa
uuuacuaaaagguucauugguuccaaucacagcucauagguagagcaaagaaaggguggaugga

SEQ ID NO: 760244 - RNA, 64 nt, hsa
cacuuagucuugccugucaaaaaguccaacauuucauagguaguaggggccacauauuacauuc

SEQ ID NO: 760245 - RNA, 64 nt, hsa
ccccaaagcaccccaaggcugguauuccuugagucauagguauuaauaauaaaagccucaaugc

SEQ ID NO: 760246 - RNA, 64 nt, hsa
agacuuucacggauucauggaacaagaaaagaagcauagguacuuuuaggugccauuagguauu

SEQ ID NO: 760247 - RNA, 64 nt, hsa
gacuuggcuuauaauaguuuuaugauuuuuacuacauagguagcacauuuaucauuugugacag

SEQ ID NO: 760248 - RNA, 64 nt, hsa
cacagcucaaagauaacagugaucacauucauuccauagguagcuuuacguguggcuacaacaa

SEQ ID NO: 760249 - RNA, 64 nt, hsa
acuuccuuugauaugcugcauagcuaguucuaggcauagguacguagugugacacuucugacuu

SEQ ID NO: 760250 - RNA, 64 nt, hsa
uaaguugauguuuaaaauugagaaauacuuuugucauagguaauuuggaacauuuacaagccau

SEQ ID NO: 760251 - RNA, 64 nt, hsa
ccagggcacugcagagucugggcagaggugggcgcauagguacaagugcugcuuugucagccuc

SEQ ID NO: 760252 - RNA, 64 nt, hsa
uguauauuccuuuguuuugaauccaaaucuuuuucauagguaaugacagaugccuuaaugugaa

SEQ ID NO: 760253 - RNA, 64 nt, hsa
agccaucauaccuaagucuuuugccaaaaccucucauagguauaucuagcugaacuuauuuugg

SEQ ID NO: 760254 - RNA, 64 nt, hsa
ugaugauuugcaagagaaaauuaguggagagucacauagguaaaucauuauuuaacuuagguuu

SEQ ID NO: 760255 - RNA, 64 nt, hsa
cuagaaguucuugauucauuuuuaccauucuuuccauagguagaagagaaaguugauugguugg

SEQ ID NO: 760256 - RNA, 64 nt, hsa
uacuucaaauggcacauagauaggcaggauauuacauagguaagcaggaauuuauacauugggu

SEQ ID NO: 760257 - RNA, 64 nt, hsa
acaugaaauuaucauaugacccagcaauucuacucauagguauauacuuaaaagaaaugaaaaa

SEQ ID NO: 760258 - RNA, 64 nt, hsa
acaguaucaacccucccaguugcuuaauuauacccauagguaauacaaaaagcucugaagaccc

SEQ ID NO: 760259 - RNA, 64 nt, hsa
uguguacacaaaggauuugaugcuuuucucucagcauagguaugcuuacuaugaccuuccaagu

SEQ ID NO: 760260 - RNA, 64 nt, hsa
aaagugcauuugccuaggacuucucagcuucucccauagguaguuuaacaggcauuaaaauuug

SEQ ID NO: 760261 - RNA, 64 nt, hsa
cuagaaagcaguuuuaggagguuccagccugcagcauagguacgaccucagaggauggcuuugc

SEQ ID NO: 760262 - RNA, 64 nt, hsa
gguucucagugacacaagaauucaguauuaaguacauagguauuuacuauggaguauaauucuc

SEQ ID NO: 760263 - RNA, 64 nt, hsa
aagauccacaaaugaagggauauaaaaauaaugucauagguaagaaacacagcaacaaugacuu

SEQ ID NO: 760264 - RNA, 64 nt, hsa
auauaagaacuguacucuucucagcuugagcuuacauagguaaauaucaccaacaucuguccuu

SEQ ID NO: 760265 - RNA, 64 nt, hsa
cauuuguauauaacacuuucagagccuucccacccauagguaguucuuaaaccaggugaaagag

SEQ ID NO: 760266 - RNA, 64 nt, hsa
uuaucccaauaaguuauugcuacugcugugaggccauagguacuagacaaccaauacaugcagg

SEQ ID NO: 760267 - RNA, 64 nt, hsa
uauuuaagaauaaaagaguacuuugaucaugagacauagguaucuugucccucucacuaaaaag

SEQ ID NO: 760268 - RNA, 64 nt, hsa
uuaaugguucaaaaaaaaucuuucuuauaaagagcauagguagaauuagugaacucuuuggauc

SEQ ID NO: 760269 - RNA, 64 nt, hsa
caacuuauuguaucugaauuccuguagcacaccucauagguaugauuuuuuuaaauuaaagaau

SEQ ID NO: 760270 - RNA, 64 nt, hsa
guugucuccuuuaagcuuuccugggucuaaccuacauagguaauuuaagaacauccucagaaag

SEQ ID NO: 760271 - RNA, 64 nt, hsa
cguuuuguuuguuuuucuaugauaauuuaaaauacauagguagggcuacugaggaaauuuggag

SEQ ID NO: 760272 - RNA, 64 nt, hsa
caucuucgcuacaaccacugacaccagcuggcgucauagguagcuagaucauugcauuuguuuu

SEQ ID NO: 760273 - RNA, 64 nt, hsa
acaaaugaauuuuccacgcaguucuuuccaugggcauagguaagcugugccuucagcuguugca

SEQ ID NO: 760274 - RNA, 64 nt, hsa
aagccucaaauguauuuuagugccacccacuggccauagguacaauucaguuguuggcuuguuu

SEQ ID NO: 760275 - RNA, 64 nt, hsa
uacaucuugggaguacaauggcccgacauuucuucauagguagaaacaaauacuugacucagug

SEQ ID NO: 760276 - RNA, 64 nt, hsa
agagauauguaucauaaaaauaaaaucuguaaaccauagguaaugauuauauaaaauacauaau

SEQ ID NO: 760277 - RNA, 64 nt, hsa
uucaaauguuaaguaaaacaagaugugccaauaucauagguaaauaaauuagggaaaauguggg

SEQ ID NO: 760278 - RNA, 64 nt, hsa
aaagaaaaaagcaaguauugcauaggcaccugagcauagguaugaccuugggaagacauuggcu

SEQ ID NO: 760279 - RNA, 64 nt, hsa
uacucacuuaaaaucaagaaucccaucuaaaacacauagguaccuuaucugaaacucuugcacu

SEQ ID NO: 760280 - RNA, 64 nt, hsa
agugaggccgugucauuggcucacaaaagugacucauagguaauuucuguguuugcauuccacu

SEQ ID NO: 760281 - RNA, 64 nt, hsa
ucaggauacaugugccgaaugugcagguuuguuacauagguauauauaugccaugauggaaaua

SEQ ID NO: 760282 - RNA, 64 nt, hsa
aucuuuacaauacuuuuuaucuuuucacuuuugacauagguaauguuguugagcaguugagcaa

SEQ ID NO: 760283 - RNA, 64 nt, hsa
ggaacacugcaagcccuuaaucagcccucugugacauagguagcagcccacggagauccuaagc

SEQ ID NO: 760284 - RNA, 64 nt, hsa
ugucuuuaagaacuaauucguacauaauaaguuucauagguaacacauuauuugaaguuacagc

SEQ ID NO: 760285 - RNA, 64 nt, hsa
ugcuaugacuacccuccuuugaucuauuuuuggucauagguaaaaaaaaaaaucucucuuggga

SEQ ID NO: 760286 - RNA, 64 nt, hsa
guuagcucagucaguccucaucgugguccugaggcauagguacuguuguaccaaggucacuuau

SEQ ID NO: 760287 - RNA, 64 nt, hsa
ucuuguguuaugaaaggcagguagauauuauagccauagguaaaaauccauaguuaaauugcac

SEQ ID NO: 760288 - RNA, 64 nt, hsa
cugccaauaaagcaggugcagcuauagaagcuggcauagguauauccuuaauggugcuuucucc

SEQ ID NO: 760289 - RNA, 64 nt, hsa
gaacuauauuuucccccaaucagaaucaucauaucauagguacaaucuuucaccaaguaaauuu

SEQ ID NO: 760290 - RNA, 64 nt, hsa
cugcauguuuuauaauuucaaaaugcaucacuuacauagguauuucucccacagaaaugaugaa

SEQ ID NO: 760291 - RNA, 64 nt, hsa
gagguccugugcccuuuacuugcuggugaggugucauagguagaaaagggcuggcccuucagau

SEQ ID NO: 760292 - RNA, 64 nt, hsa
guaucacugcagucaccucuucuacccucaucaucauagguaagguuuucaagguggcaauugg

SEQ ID NO: 760293 - RNA, 64 nt, hsa
uacgugcuuugugcauuguagucuagucguaauucauagguacugacuccucagccccaaaugu

SEQ ID NO: 760294 - RNA, 64 nt, hsa
ucuggaacguuccagccaggcagugguuguuccucauagguagguggccuuggccuucauccca

SEQ ID NO: 760295 - RNA, 64 nt, hsa
uucucauugccagauuccauuacccuuucuuccucauagguaguaauuaccaauguaacuaagc

SEQ ID NO: 760296 - RNA, 64 nt, hsa
ggaaagagccuuguaucauaugugaacauuguaucauagguaauguuguacagacccuuuuaua

SEQ ID NO: 760297 - RNA, 64 nt, hsa
uauuuccuacuguguaggagaauuugcagucagccauagguauguaggaauagucacucacugg

SEQ ID NO: 760298 - RNA, 64 nt, hsa
agggagguggccagcgcccccgggcacugcugcucauagguaccuuuccacugccuccucccug

SEQ ID NO: 760299 - RNA, 64 nt, hsa
cauuaauugucagauuccacuacacuuucuuccucauagguaguaauuaccaguguaacuaagc

SEQ ID NO: 760300 - RNA, 64 nt, hsa
gggucaaaccacugccuuggccccaggaaggggccauagguaggucugaacaacugccgcaaga

SEQ ID NO: 760301 - RNA, 64 nt, hsa
ccucucucaugguugucucuuucccccgcuaugucauagguaguggaggaagcgaaggaaguga

SEQ ID NO: 760302 - RNA, 64 nt, hsa
acagaucucuuaauaagugaaucuaguggaagaacauagguaucauucuaauuccaugguaaau

SEQ ID NO: 760303 - RNA, 64 nt, hsa
uguaaguaaucugaaagcaauagugcaugaauuucauagguaguguuguuuuaggucaguaaau

SEQ ID NO: 760304 - RNA, 64 nt, hsa
gugagaagaguauguggccucuuuguuacugagucauagguauuugcugagauuugcuauuagg

SEQ ID NO: 760305 - RNA, 64 nt, hsa
uauacacauauguguguugaauaauuacuauuggcauagguauguguauacacacggugcacca

SEQ ID NO: 760306 - RNA, 64 nt, hsa
ccagggcacauguacaggaccugcagcuuuguuacauagguaggcuugugccauggugguuugc

SEQ ID NO: 760307 - RNA, 64 nt, hsa
cuggcagauuuggugucugaugggguauguucuucauagguagugcuugugucuugaugugugu

SEQ ID NO: 760308 - RNA, 64 nt, hsa
ccgggauacaugugcaggaccugcagguuuguuacauagguaagccugugccauggugguuugc

SEQ ID NO: 760309 - RNA, 64 nt, hsa
cuuuuuuuuucuucuuaccaucauuuaugcaugacauagguaaugugacuaauuucuccaguug

SEQ ID NO: 760310 - RNA, 64 nt, hsa
gguccuggcccuccucccccaucugcacccccaucauagguagagaccccacccucccaucggu

SEQ ID NO: 760311 - RNA, 64 nt, hsa
uaacaacacaggugacucuuucccuugauaaagucauagguaauucaggggcugggugcggcgg

SEQ ID NO: 760312 - RNA, 64 nt, hsa
uuugcacuggacauauucccuaccugucuuauuucauagguacaugaaguauuguguauaaaaa

SEQ ID NO: 760313 - RNA, 64 nt, hsa
uuugcacuggacauauucccuaccuguuuuauuucauagguacaugaaguauuguguauaaaaa

SEQ ID NO: 760314 - RNA, 64 nt, hsa
cauuuagaaaggacagaaaauauuuaaaguggcucauagguaaugaauauuucugacuuagaug

SEQ ID NO: 760315 - RNA, 64 nt, hsa
uaaauauuagauuaugauguucaguaacaucuuccauagguauaaacugcugucauuauugauu

SEQ ID NO: 760316 - RNA, 64 nt, hsa
auccuguuggcuuuggguuuccugacccaucccgcauagguagagccucuuguuccuaggcaug

SEQ ID NO: 760317 - RNA, 64 nt, hsa
uacuaaggauaaagcuuuagaagcuauuuuacuacauagguaaagaaaagauaaacuaacuugu

SEQ ID NO: 760318 - RNA, 64 nt, hsa
uauauuagcucauucauuccucacaauucuacaacauagguaucauuccaaccucuauuuuaca

SEQ ID NO: 760319 - RNA, 64 nt, hsa; identical to SEQ ID NO: 110389

SEQ ID NO: 760320 - RNA, 64 nt, hsa; identical to SEQ ID NO: 110390

SEQ ID NO: 760321 - RNA, 64 nt, hsa; identical to SEQ ID NO: 110391

SEQ ID NO: 760322 - RNA, 64 nt, hsa; identical to SEQ ID NO: 110392

SEQ ID NO: 760323 - RNA, 64 nt, hsa; identical to SEQ ID NO: 110393

SEQ ID NO: 760324 - RNA, 63 nt, hsa; identical to SEQ ID NO: 110394

SEQ ID NO: 760325 - RNA, 60 nt, hsa; identical to SEQ ID NO: 110395

SEQ ID NO: 760326 - RNA, 64 nt, hsa; identical to SEQ ID NO: 110396

SEQ ID NO: 760327 - RNA, 64 nt, hsa; identical to SEQ ID NO: 110397

SEQ ID NO: 760328 - RNA, 64 nt, hsa; identical to SEQ ID NO: 110398

SEQ ID NO: 760329 - RNA, 64 nt, hsa; identical to SEQ ID NO: 110399

SEQ ID NO: 760330 - RNA, 64 nt, hsa; identical to SEQ ID NO: 110400

SEQ ID NO: 760331 - RNA, 64 nt, hsa; identical to SEQ ID NO: 110401

SEQ ID NO: 760332 - RNA, 58 nt, hsa; identical to SEQ ID NO: 110402

SEQ ID NO: 760333 - RNA, 64 nt, hsa; identical to SEQ ID NO: 110403

SEQ ID NO: 760334 - RNA, 64 nt, hsa; identical to SEQ ID NO: 110404

SEQ ID NO: 760335 - RNA, 64 nt, hsa; identical to SEQ ID NO: 110405

SEQ ID NO: 760336 - RNA, 64 nt, hsa; identical to SEQ ID NO: 110406

SEQ ID NO: 760337 - RNA, 64 nt, hsa; identical to SEQ ID NO: 110407

SEQ ID NO: 760338 - RNA, 64 nt, hsa; identical to SEQ ID NO: 110408

SEQ ID NO: 760339 - RNA, 64 nt, hsa; identical to SEQ ID NO: 110409

SEQ ID NO: 760340 - RNA, 64 nt, hsa; identical to SEQ ID NO: 110410

SEQ ID NO: 760341 - RNA, 64 nt, hsa; identical to SEQ ID NO: 110411

SEQ ID NO: 760342 - RNA, 64 nt, hsa; identical to SEQ ID NO: 110412

SEQ ID NO: 760343 - RNA, 64 nt, hsa; identical to SEQ ID NO: 110413

SEQ ID NO: 760344 - RNA, 64 nt, hsa; identical to SEQ ID NO: 110414

SEQ ID NO: 760345 - RNA, 64 nt, hsa; identical to SEQ ID NO: 110415

SEQ ID NO: 760346 - RNA, 64 nt, hsa; identical to SEQ ID NO: 110416

SEQ ID NO: 760347 - RNA, 64 nt, hsa; identical to SEQ ID NO: 110417

SEQ ID NO: 760348 - RNA, 64 nt, hsa; identical to SEQ ID NO: 110418

SEQ ID NO: 760349 - RNA, 64 nt, hsa; identical to SEQ ID NO: 110419

SEQ ID NO: 760350 - RNA, 64 nt, hsa; identical to SEQ ID NO: 110420

SEQ ID NO: 760351 - RNA, 64 nt, hsa; identical to SEQ ID NO: 110421

SEQ ID NO: 760352 - RNA, 64 nt, hsa; identical to SEQ ID NO: 110422

SEQ ID NO: 760353 - RNA, 64 nt, hsa; identical to SEQ ID NO: 110423

SEQ ID NO: 760354 - RNA, 64 nt, hsa; identical to SEQ ID NO: 110424

SEQ ID NO: 760355 - RNA, 64 nt, hsa; identical to SEQ ID NO: 110425

SEQ ID NO: 760356 - RNA, 64 nt, hsa; identical to SEQ ID NO: 110426

SEQ ID NO: 760357 - RNA, 64 nt, hsa; identical to SEQ ID NO: 110427

SEQ ID NO: 760358 - RNA, 64 nt, hsa; identical to SEQ ID NO: 110428

SEQ ID NO: 760359 - RNA, 64 nt, hsa; identical to SEQ ID NO: 110429

SEQ ID NO: 760360 - RNA, 64 nt, hsa; identical to SEQ ID NO: 110430

SEQ ID NO: 760361 - RNA, 64 nt, hsa; identical to SEQ ID NO: 110431

SEQ ID NO: 760362 - RNA, 64 nt, hsa; identical to SEQ ID NO: 110432

SEQ ID NO: 760363 - RNA, 64 nt, hsa; identical to SEQ ID NO: 110433

SEQ ID NO: 760364 - RNA, 64 nt, hsa; identical to SEQ ID NO: 110434

SEQ ID NO: 760365 - RNA, 64 nt, hsa; identical to SEQ ID NO: 110435

SEQ ID NO: 760366 - RNA, 64 nt, hsa; identical to SEQ ID NO: 110436

SEQ ID NO: 760367 - RNA, 64 nt, hsa; identical to SEQ ID NO: 110437

SEQ ID NO: 760368 - RNA, 64 nt, hsa; identical to SEQ ID NO: 110438

SEQ ID NO: 760369 - RNA, 64 nt, hsa; identical to SEQ ID NO: 110439

SEQ ID NO: 760370 - RNA, 64 nt, hsa; identical to SEQ ID NO: 607606

SEQ ID NO: 760371 - RNA, 64 nt, hsa; identical to SEQ ID NO: 607607

SEQ ID NO: 760372 - RNA, 64 nt, hsa; identical to SEQ ID NO: 607608

SEQ ID NO: 760373 - RNA, 64 nt, hsa; identical to SEQ ID NO: 607609

SEQ ID NO: 760374 - RNA, 64 nt, hsa; identical to SEQ ID NO: 607610

SEQ ID NO: 760375 - RNA, 64 nt, hsa; identical to SEQ ID NO: 607611

SEQ ID NO: 760376 - RNA, 64 nt, hsa; identical to SEQ ID NO: 607612

SEQ ID NO: 760377 - RNA, 64 nt, hsa; identical to SEQ ID NO: 607613

SEQ ID NO: 760378 - RNA, 64 nt, hsa; identical to SEQ ID NO: 607614

SEQ ID NO: 760379 - RNA, 64 nt, hsa; identical to SEQ ID NO: 607615

SEQ ID NO: 760380 - RNA, 64 nt, hsa
cauuuuuaauuguccuguaauggaacaguagcaaauucacuaaacuuuuguguucagaguuaaa

SEQ ID NO: 760381 - RNA, 64 nt, hsa
augugaauuaaaaauuuuggaacaauuagaauucauucacuauuguauagaagaugcuguuaaa

SEQ ID NO: 760382 - RNA, 64 nt, hsa; identical to SEQ ID NO: 71798

SEQ ID NO: 760383 - RNA, 64 nt, hsa; identical to SEQ ID NO: 71799

SEQ ID NO: 760384 - RNA, 64 nt, hsa; identical to SEQ ID NO: 71800

SEQ ID NO: 760385 - RNA, 64 nt, hsa; identical to SEQ ID NO: 71801

SEQ ID NO: 760386 - RNA, 64 nt, hsa; identical to SEQ ID NO: 71802

SEQ ID NO: 760387 - RNA, 64 nt, hsa; identical to SEQ ID NO: 71803

SEQ ID NO: 760388 - RNA, 64 nt, hsa; identical to SEQ ID NO: 71804

SEQ ID NO: 760389 - RNA, 64 nt, hsa; identical to SEQ ID NO: 71805

SEQ ID NO: 760390 - RNA, 64 nt, hsa; identical to SEQ ID NO: 71806

SEQ ID NO: 760391 - RNA, 64 nt, hsa; identical to SEQ ID NO: 71807

SEQ ID NO: 760392 - RNA, 64 nt, hsa; identical to SEQ ID NO: 71808

SEQ ID NO: 760393 - RNA, 64 nt, hsa; identical to SEQ ID NO: 71809

SEQ ID NO: 760394 - RNA, 64 nt, hsa; identical to SEQ ID NO: 71810

SEQ ID NO: 760395 - RNA, 64 nt, hsa; identical to SEQ ID NO: 71811

SEQ ID NO: 760396 - RNA, 64 nt, hsa; identical to SEQ ID NO: 154250

SEQ ID NO: 760397 - RNA, 64 nt, hsa; identical to SEQ ID NO: 154251

SEQ ID NO: 760398 - RNA, 64 nt, hsa; identical to SEQ ID NO: 154252

SEQ ID NO: 760399 - RNA, 64 nt, hsa; identical to SEQ ID NO: 154253

SEQ ID NO: 760400 - RNA, 64 nt, hsa; identical to SEQ ID NO: 154254

SEQ ID NO: 760401 - RNA, 64 nt, hsa; identical to SEQ ID NO: 154255

SEQ ID NO: 760402 - RNA, 64 nt, hsa; identical to SEQ ID NO: 154256

SEQ ID NO: 760403 - RNA, 64 nt, hsa; identical to SEQ ID NO: 154257

SEQ ID NO: 760404 - RNA, 64 nt, hsa; identical to SEQ ID NO: 154258

SEQ ID NO: 760405 - RNA, 64 nt, hsa; identical to SEQ ID NO: 154259

SEQ ID NO: 760406 - RNA, 64 nt, hsa; identical to SEQ ID NO: 154260

SEQ ID NO: 760407 - RNA, 64 nt, hsa; identical to SEQ ID NO: 154261

SEQ ID NO: 760408 - RNA, 64 nt, hsa; identical to SEQ ID NO: 154262

SEQ ID NO: 760409 - RNA, 64 nt, hsa; identical to SEQ ID NO: 154263

SEQ ID NO: 760410 - RNA, 64 nt, hsa; identical to SEQ ID NO: 154264

SEQ ID NO: 760411 - RNA, 64 nt, hsa; identical to SEQ ID NO: 154265

SEQ ID NO: 760412 - RNA, 64 nt, hsa; identical to SEQ ID NO: 154266

SEQ ID NO: 760413 - RNA, 64 nt, hsa; identical to SEQ ID NO: 154267

SEQ ID NO: 760414 - RNA, 64 nt, hsa; identical to SEQ ID NO: 154268

SEQ ID NO: 760415 - RNA, 64 nt, hsa; identical to SEQ ID NO: 154269

SEQ ID NO: 760416 - RNA, 64 nt, hsa; identical to SEQ ID NO: 154270

SEQ ID NO: 760417 - RNA, 64 nt, hsa; identical to SEQ ID NO: 154271

SEQ ID NO: 760418 - RNA, 64 nt, hsa; identical to SEQ ID NO: 154272

SEQ ID NO: 760419 - RNA, 64 nt, hsa; identical to SEQ ID NO: 154273

SEQ ID NO: 760420 - RNA, 64 nt, hsa; identical to SEQ ID NO: 154274

SEQ ID NO: 760421 - RNA, 64 nt, hsa; identical to SEQ ID NO: 154275

SEQ ID NO: 760422 - RNA, 64 nt, hsa; identical to SEQ ID NO: 154276

SEQ ID NO: 760423 - RNA, 64 nt, hsa; identical to SEQ ID NO: 154277

SEQ ID NO: 760424 - RNA, 64 nt, hsa; identical to SEQ ID NO: 154278

SEQ ID NO: 760425 - RNA, 64 nt, hsa; identical to SEQ ID NO: 99218

SEQ ID NO: 760426 - RNA, 64 nt, hsa; identical to SEQ ID NO: 99219

SEQ ID NO: 760427 - RNA, 64 nt, hsa; identical to SEQ ID NO: 99220

SEQ ID NO: 760428 - RNA, 64 nt, hsa; identical to SEQ ID NO: 99221

SEQ ID NO: 760429 - RNA, 64 nt, hsa; identical to SEQ ID NO: 99222

SEQ ID NO: 760430 - RNA, 64 nt, hsa; identical to SEQ ID NO: 99223

SEQ ID NO: 760431 - RNA, 64 nt, hsa; identical to SEQ ID NO: 99224

SEQ ID NO: 760432 - RNA, 64 nt, hsa; identical to SEQ ID NO: 99225

SEQ ID NO: 760433 - RNA, 64 nt, hsa; identical to SEQ ID NO: 99226

SEQ ID NO: 760434 - RNA, 64 nt, hsa; identical to SEQ ID NO: 99227

SEQ ID NO: 760435 - RNA, 64 nt, hsa; identical to SEQ ID NO: 99228

SEQ ID NO: 760436 - RNA, 64 nt, hsa; identical to SEQ ID NO: 99229

SEQ ID NO: 760437 - RNA, 64 nt, hsa; identical to SEQ ID NO: 99230

SEQ ID NO: 760438 - RNA, 64 nt, hsa; identical to SEQ ID NO: 99231

SEQ ID NO: 760439 - RNA, 64 nt, hsa; identical to SEQ ID NO: 99232

SEQ ID NO: 760440 - RNA, 64 nt, hsa; identical to SEQ ID NO: 99233

SEQ ID NO: 760441 - RNA, 64 nt, hsa; identical to SEQ ID NO: 99234

SEQ ID NO: 760442 - RNA, 64 nt, hsa; identical to SEQ ID NO: 99235

SEQ ID NO: 760443 - RNA, 64 nt, hsa; identical to SEQ ID NO: 99236

SEQ ID NO: 760444 - RNA, 64 nt, hsa; identical to SEQ ID NO: 99237

SEQ ID NO: 760445 - RNA, 64 nt, hsa; identical to SEQ ID NO: 99238

SEQ ID NO: 760446 - RNA, 64 nt, hsa; identical to SEQ ID NO: 99239

SEQ ID NO: 760447 - RNA, 64 nt, hsa; identical to SEQ ID NO: 99240

SEQ ID NO: 760448 - RNA, 64 nt, hsa; identical to SEQ ID NO: 99241

SEQ ID NO: 760449 - RNA, 64 nt, hsa; identical to SEQ ID NO: 534582

SEQ ID NO: 760450 - RNA, 64 nt, hsa; identical to SEQ ID NO: 534583

SEQ ID NO: 760451 - RNA, 64 nt, hsa; identical to SEQ ID NO: 534584

SEQ ID NO: 760452 - RNA, 64 nt, hsa; identical to SEQ ID NO: 534585

SEQ ID NO: 760453 - RNA, 64 nt, hsa; identical to SEQ ID NO: 534586

SEQ ID NO: 760454 - RNA, 64 nt, hsa; identical to SEQ ID NO: 534587

SEQ ID NO: 760455 - RNA, 64 nt, hsa; identical to SEQ ID NO: 534588

SEQ ID NO: 760456 - RNA, 64 nt, hsa; identical to SEQ ID NO: 534589

SEQ ID NO: 760457 - RNA, 64 nt, hsa; identical to SEQ ID NO: 534590

SEQ ID NO: 760458 - RNA, 64 nt, hsa; identical to SEQ ID NO: 534591

SEQ ID NO: 760459 - RNA, 64 nt, hsa; identical to SEQ ID NO: 534592

SEQ ID NO: 760460 - RNA, 64 nt, hsa; identical to SEQ ID NO: 534593

SEQ ID NO: 760461 - RNA, 64 nt, hsa; identical to SEQ ID NO: 534594

SEQ ID NO: 760462 - RNA, 64 nt, hsa; identical to SEQ ID NO: 534595

SEQ ID NO: 760463 - RNA, 64 nt, hsa; identical to SEQ ID NO: 534596

SEQ ID NO: 760464 - RNA, 64 nt, hsa
gacuuaccccagcuaccguuaaaugaggacaaaucaccuuaaaacauguucauuugauucauaa

SEQ ID NO: 760465 - RNA, 64 nt, hsa
uuucaaacuauguuuuacuuguauaugauguagucaccuuaacuaucuuucaauuccauacuuc

SEQ ID NO: 760466 - RNA, 64 nt, hsa
uuuuggaugccauuugauuguaauaaaacuguggcaccuuaauuuugaauggcagcaugaucau

SEQ ID NO: 760467 - RNA, 64 nt, hsa
gaaauauuuaggauaaacaaaauucuauuuaauccaccuuaaaaccuaaauguauuuucaugga

SEQ ID NO: 760468 - RNA, 64 nt, hsa
caccagugaaaggcuuugagaaggacgugggcagcaaaacgacacugcgcaucaccuaccccga

SEQ ID NO: 760469 - RNA, 64 nt, hsa
gauaaguuggauucuuucagagcauucuuuuccucaaaacgagcugcauaauucuuggaauuua

SEQ ID NO: 760470 - RNA, 64 nt, hsa
ccgagaucgcaccacugcacuccagccuaggagacaaaacgagacuucauuuaaaaaaaauaaa

SEQ ID NO: 760471 - RNA, 64 nt, hsa
cuucuuaucuggaugaaggcuuuuggaggagaaccaaaacgacaaguuccaagaagaagaugaa

SEQ ID NO: 760472 - RNA, 64 nt, hsa
aagaaaccauuaauguuuaauuuaaucuuaauaccaaaacgaccagauugaaguuugacuuuua

SEQ ID NO: 760473 - RNA, 64 nt, hsa
agccugggcaacagagcaagacugucucaaaaaacaaaacgaaacaaaaaaagaaaguuauucu

SEQ ID NO: 760474 - RNA, 64 nt, hsa
cugcugguggguuagaucaaggaauaaauguuugcaaaacgaaccuugucaggagcaccuccua

SEQ ID NO: 760475 - RNA, 64 nt, hsa
uauuugccuuaggucagauucuacuaguuuaaagcaaaacgaucuccuggucugauuccuuugg

SEQ ID NO: 760476 - RNA, 64 nt, hsa
uugaaagggaaaaaagacaaaaagcauaaggcuccaaaacgaaagcaagcauuucacuggcagc

SEQ ID NO: 760477 - RNA, 64 nt, hsa
ucauauaauaaggugaugucggaaacacgcaaaacaaaacgaaaaaagauuucucaguauacac

SEQ ID NO: 760478 - RNA, 50 nt, hsa
acgcggucgccccuuuguaacaaaacgaaagagucuaagcauugccacuu

SEQ ID NO: 760479 - RNA, 64 nt, hsa
cuccaggucggcacuuuccacuucuguacgguggcaaaacgaugacauguaaccuugcuguuua

SEQ ID NO: 760480 - RNA, 64 nt, hsa
aagcuccuuuguauaucuugguaauuuauauuuucaaaacgaaguucuuacuuuuaaagagaau

SEQ ID NO: 760481 - RNA, 64 nt, hsa
uugggaguuuaaauuacuucaggggaagagaagacaaaacgagucuuucauucggugugaacuu

SEQ ID NO: 760482 - RNA, 64 nt, hsa
gggaauaaaucaugacuuaucccauuuucaauaacaaaacgaaacuauggcacuaaccaaaaac

SEQ ID NO: 760483 - RNA, 64 nt, hsa
cuggacguguuuagauaguuuccaccaugaggugcaaaacgagacagaagagugagaagcagau

SEQ ID NO: 760484 - RNA, 64 nt, hsa
uguauugagugccuauucauugucacuguagaugcaaaacgaaugagcuguaaccccuucacuc

SEQ ID NO: 760485 - RNA, 64 nt, hsa
cauuuuuuccugaucugucaucuucauagcacaacaaaacgaaaugauggaaaugcucuugagc

SEQ ID NO: 760486 - RNA, 64 nt, hsa
cuaagggccauccaaccauccaaccuuuaaaaaacaaaacgaaagugcuucucaucaaugauau

SEQ ID NO: 760487 - RNA, 64 nt, hsa
uuauuaagaggcuauaugcaucuuuuugguuugucaaaacgagggcauuacaaaaauuuagcua

SEQ ID NO: 760488 - RNA, 64 nt, hsa
ugaagauucaagucaguuguucaguuacuugaagcaaaacgaaaucuuucauuucagucaaauc

SEQ ID NO: 760489 - RNA, 64 nt, hsa
aaccucugagccuugguguacagaccaccuuucacaaaacgaaaugcuaugacuguaucuugau

SEQ ID NO: 760490 - RNA, 50 nt, hsa
gagauucucugagugccugacaaaacgaauuuaaguaccagccaaguaca

SEQ ID NO: 760491 - RNA, 64 nt, hsa
acgugccuccauaaccugaacugugccgacuccacaaaacgauuauguacucuucugagauaga

SEQ ID NO: 760492 - RNA, 64 nt, hsa
uggggaaggcuuuguauaaucccacccaccucaccaaaacgaugaaguuaugcugucauggucc

SEQ ID NO: 760493 - RNA, 64 nt, hsa
uggacccugcguuugccgagcgcuaugccccggacaaaacgagcacagugcugacccggcacag

SEQ ID NO: 760494 - RNA, 64 nt, hsa
ucgcaaauuuuccaaucucccacucacguuuuuacaaaacgaaugcucuaaauucugaggauuc

SEQ ID NO: 760495 - RNA, 64 nt, hsa
cuccccuaugcucaugcccacacagacaaaaaaacaaaacgaaauacacacagaaaaaagucuu

SEQ ID NO: 760496 - RNA, 64 nt, hsa
gaaaaaaggaaaaaaaaucaaaacacaaaaaagccaaaacgaaaacaaaucucgaguguguugc

SEQ ID NO: 760497 - RNA, 64 nt, hsa
aguguaccguaaauguuguguuuucagaaaaagacaaaacgauggugcugacugguuuucugua

SEQ ID NO: 760498 - RNA, 64 nt, hsa
agugaaagcuccugugguuuugcucagccaaaaccaaaacgaggggaagaggaugauuccuaac

SEQ ID NO: 760499 - RNA, 64 nt, hsa
aguaagaugugaaauucacaaaaaguaaaccaaacaaaacgaaugaaaaacuggaaauaauucg

SEQ ID NO: 760500 - RNA, 64 nt, hsa
aauuuaugaugcugugacaagaaauuuaaagaaucaaaacgaugguuugaaaaggaaaccuaug

SEQ ID NO: 760501 - RNA, 64 nt, hsa
uauuauauguuacaauaagccuccauuagucccucaaaacgaugauauaaauaagucuguacaa

SEQ ID NO: 760502 - RNA, 64 nt, hsa
acaucuacaccaguaaaguguaauaggucaguuucaaaacgaccaaaagacccaccacuguauu

SEQ ID NO: 760503 - RNA, 64 nt, hsa
cuguguauacauggauauuuuguuuguuuuuaaacaaaacgaugggaucauucugaacauacug

SEQ ID NO: 760504 - RNA, 64 nt, hsa
cuuuuaaaagagaaaaauuauuucagugauuugucaaaacgaauuaccucuuuuggcaugagcu

SEQ ID NO: 760505 - RNA, 64 nt, hsa
cuaaaaggaaaauuaguauuuuggauagauuugucaaaacgacauuuaagucauguuuaaaaag

SEQ ID NO: 760506 - RNA, 64 nt, hsa
gucgcuuugguguugguuucguucccgucuucagcaaaacgaccuuggaaccucaaugggggcu

SEQ ID NO: 760507 - RNA, 64 nt, hsa
aggaauagcagaacauuucuccugccccucguugcaaaacgagcuuguuucccugaaccucaga

SEQ ID NO: 760508 - RNA, 64 nt, hsa
aauaaugguuuccaaagaguauuuuuuaaaggaacaaaacgagcaugaauuaacucuucaauau

SEQ ID NO: 760509 - RNA, 64 nt, hsa
uagguggagguggggcaugguauuugagacauuccaaaacgaaggccucugaaggacccuucag

SEQ ID NO: 760510 - RNA, 64 nt, hsa
gucaagccgagcaaccuguauaagcagcccaacacaaaacgaguguggauuuaucuaaauggag

SEQ ID NO: 760511 - RNA, 64 nt, hsa
auaauaaggcuuauuuucacagaauaaaauaaagcaaaacgagggaggauuuuauugggggaag

SEQ ID NO: 760512 - RNA, 64 nt, hsa
cguggcaacacacuucacugaacccacuugcuuccaaaacgaugccagcccgaggcacugcuac

SEQ ID NO: 760513 - RNA, 64 nt, hsa
uuuguuauuuguauuugcuagucucugauuuccucaaaacgaaguggaauuuacuacuguuguc

SEQ ID NO: 760514 - RNA, 64 nt, hsa
aaagcguuuucuuugcucgaggggacaaaaaagucaaaacgaggcgagaggcgaagcccacuuu

SEQ ID NO: 760515 - RNA, 64 nt, hsa
aguucacuuggaggcuaaaaaucuccagugaaaacaaaacgaaaaccuuuaagagaauguagag

SEQ ID NO: 760516 - RNA, 64 nt, hsa
aaugcaguccugaggagaggaguuuucuccauaucaaaacgagggcugauggaggaaaaagguc

SEQ ID NO: 760517 - RNA, 64 nt, hsa
aagugguaaaaucugguauuuacuggcuuacacucaaaacgaccacaguccuaccucaguucaa

SEQ ID NO: 760518 - RNA, 64 nt, hsa
gacagguuguagacacacccuccccuaacaaaaacaaaacgaaagaguucauacucugauuuuc

SEQ ID NO: 760519 - RNA, 64 nt, hsa
auugccgugacagguuuccacaaacuucguggaucaaaacgaggucuuccaguucugcggguca

SEQ ID NO: 760520 - RNA, 64 nt, hsa
cuccugcuuuucagaggcccgagugcauuuaucccaaaacgaggcaucuugacauccccuaucc

SEQ ID NO: 760521 - RNA, 64 nt, hsa
ccagaggauggacuaagugggagaaauuagaaaacaaaacgaacucugguugggguacuacgau

SEQ ID NO: 760522 - RNA, 64 nt, hsa
ccauauuucacuggugguuggagaaaaccauggccaaaacgauuguggcaggucucaaucuugg

SEQ ID NO: 760523 - RNA, 64 nt, hsa
aaaauagagauuucacaucugcccagaccccacucaaaacgauuuggucagguucugguuggac

SEQ ID NO: 760524 - RNA, 64 nt, hsa
aaggcaauuccuauugcuuccuugcgcaacuucucaaaacgaugaaagucagaaggcugucaaa

SEQ ID NO: 760525 - RNA, 64 nt, hsa
uacauuuuguuuuuccauuuaauuuaauaaucaacaaaacgacaaagucaguuuaauaucuuuc

SEQ ID NO: 760526 - RNA, 64 nt, hsa
caaaucucacugcuccugacccagccuguguauucaaaacgaaaacaguaaaaccaacaucagg

SEQ ID NO: 760527 - RNA, 64 nt, hsa
acccaauagaaucacucgaaaaagaaucugcuuucaaaacgaaagcugaaccuauaagcagcag

SEQ ID NO: 760528 - RNA, 64 nt, hsa
uuucucuccaggugcagccagaucucacaaaguacaaaacgaaugccuuucuuuucuuguuuau

SEQ ID NO: 760529 - RNA, 64 nt, hsa
ccugcuucuuuggguugccaaucaagaguauccucaaaacgacuugacuuuaauuuucucggag

SEQ ID NO: 760530 - RNA, 64 nt, hsa
caaagagaccagccucccucccugugccagaccucaaaacgacgggggcaggugcaaguucaua

SEQ ID NO: 760531 - RNA, 64 nt, hsa
cuugaaagauccagaacaaaaaguccugaaaauccaaaacgauaguguagguaagacaauaaug

SEQ ID NO: 760532 - RNA, 64 nt, hsa
gggugguucucugggccucaguuucccuccucugcaaaacgagggggucagcccaagauucuuc

SEQ ID NO: 760533 - RNA, 64 nt, hsa
ucagagagaauacacguggcuauaacaucuauaacaaaacgacgauuccucuacaagaggcugu

SEQ ID NO: 760534 - RNA, 64 nt, hsa
ccacagauccauuuuuagggaagggauuuuggcucaaaacgaucugaccaccucugcccugucc

SEQ ID NO: 760535 - RNA, 64 nt, hsa
guggccaaggcugagagcucucucuucucuguuacaaaacgagauaagcaaguguuagaauugc

SEQ ID NO: 760536 - RNA, 64 nt, hsa
uguugaucuguguuuuagaauaguccaagugaagcaaaacgaacugagagagcugauuuacauc

SEQ ID NO: 760537 - RNA, 64 nt, hsa
acagcuucaaaauaugcagcaaaaaccaauacaacaaaacgaguggcacgauuuauuucaaacu

SEQ ID NO: 760538 - RNA, 64 nt, hsa
cacgcacacacacauauggggaccugcacaccugcaaaacgagggaacaacuaagguggcugaa

SEQ ID NO: 760539 - RNA, 64 nt, hsa
uguucuaaacaauuucaauuuaauucauugucaacaaaacgauagaauguuuugcuuggaagaa

SEQ ID NO: 760540 - RNA, 64 nt, hsa
aaaaacaucugaagauggauugggugagggcuggcaaaacgaaggcaugccgggccagcuccuu

SEQ ID NO: 760541 - RNA, 64 nt, hsa; identical to SEQ ID NO: 137985

SEQ ID NO: 760542 - RNA, 64 nt, hsa; identical to SEQ ID NO: 137986

SEQ ID NO: 760543 - RNA, 64 nt, hsa; identical to SEQ ID NO: 137987

SEQ ID NO: 760544 - RNA, 64 nt, hsa; identical to SEQ ID NO: 137988

SEQ ID NO: 760545 - RNA, 64 nt, hsa; identical to SEQ ID NO: 137989

SEQ ID NO: 760546 - RNA, 64 nt, hsa; identical to SEQ ID NO: 137990

SEQ ID NO: 760547 - RNA, 64 nt, hsa; identical to SEQ ID NO: 137991

SEQ ID NO: 760548 - RNA, 64 nt, hsa; identical to SEQ ID NO: 137992

SEQ ID NO: 760549 - RNA, 64 nt, hsa; identical to SEQ ID NO: 137993

SEQ ID NO: 760550 - RNA, 64 nt, hsa; identical to SEQ ID NO: 137994

SEQ ID NO: 760551 - RNA, 64 nt, hsa; identical to SEQ ID NO: 137995

SEQ ID NO: 760552 - RNA, 64 nt, hsa; identical to SEQ ID NO: 137996

SEQ ID NO: 760553 - RNA, 64 nt, hsa; identical to SEQ ID NO: 137997

SEQ ID NO: 760554 - RNA, 64 nt, hsa; identical to SEQ ID NO: 137998

SEQ ID NO: 760555 - RNA, 64 nt, hsa; identical to SEQ ID NO: 137999

SEQ ID NO: 760556 - RNA, 64 nt, hsa; identical to SEQ ID NO: 138000

SEQ ID NO: 760557 - RNA, 64 nt, hsa; identical to SEQ ID NO: 138001

SEQ ID NO: 760558 - RNA, 64 nt, hsa; identical to SEQ ID NO: 138002

SEQ ID NO: 760559 - RNA, 64 nt, hsa; identical to SEQ ID NO: 138003

SEQ ID NO: 760560 - RNA, 64 nt, hsa; identical to SEQ ID NO: 138004

SEQ ID NO: 760561 - RNA, 64 nt, hsa; identical to SEQ ID NO: 138005

SEQ ID NO: 760562 - RNA, 64 nt, hsa; identical to SEQ ID NO: 138006

SEQ ID NO: 760563 - RNA, 64 nt, hsa; identical to SEQ ID NO: 138007

SEQ ID NO: 760564 - RNA, 64 nt, hsa; identical to SEQ ID NO: 138008

SEQ ID NO: 760565 - RNA, 64 nt, hsa; identical to SEQ ID NO: 138009

SEQ ID NO: 760566 - RNA, 64 nt, hsa; identical to SEQ ID NO: 138010

SEQ ID NO: 760567 - RNA, 64 nt, hsa; identical to SEQ ID NO: 572067

SEQ ID NO: 760568 - RNA, 64 nt, hsa; identical to SEQ ID NO: 572068

SEQ ID NO: 760569 - RNA, 64 nt, hsa; identical to SEQ ID NO: 572069

SEQ ID NO: 760570 - RNA, 64 nt, hsa; identical to SEQ ID NO: 572070

SEQ ID NO: 760571 - RNA, 64 nt, hsa; identical to SEQ ID NO: 572071

SEQ ID NO: 760572 - RNA, 64 nt, hsa; identical to SEQ ID NO: 572072

SEQ ID NO: 760573 - RNA, 62 nt, hsa; identical to SEQ ID NO: 443387

SEQ ID NO: 760574 - RNA, 62 nt, hsa; identical to SEQ ID NO: 443388

SEQ ID NO: 760575 - RNA, 62 nt, hsa; identical to SEQ ID NO: 443389

SEQ ID NO: 760576 - RNA, 62 nt, hsa; identical to SEQ ID NO: 443390

SEQ ID NO: 760577 - RNA, 62 nt, hsa; identical to SEQ ID NO: 443391

SEQ ID NO: 760578 - RNA, 62 nt, hsa; identical to SEQ ID NO: 443392

SEQ ID NO: 760579 - RNA, 62 nt, hsa; identical to SEQ ID NO: 443393

SEQ ID NO: 760580 - RNA, 62 nt, hsa; identical to SEQ ID NO: 443394

SEQ ID NO: 760581 - RNA, 62 nt, hsa; identical to SEQ ID NO: 443395

SEQ ID NO: 760582 - RNA, 62 nt, hsa; identical to SEQ ID NO: 443396

SEQ ID NO: 760583 - RNA, 62 nt, hsa; identical to SEQ ID NO: 443397

SEQ ID NO: 760584 - RNA, 62 nt, hsa; identical to SEQ ID NO: 443398

SEQ ID NO: 760585 - RNA, 62 nt, hsa; identical to SEQ ID NO: 443399

SEQ ID NO: 760586 - RNA, 62 nt, hsa; identical to SEQ ID NO: 443400

SEQ ID NO: 760587 - RNA, 62 nt, hsa; identical to SEQ ID NO: 443401

SEQ ID NO: 760588 - RNA, 62 nt, hsa; identical to SEQ ID NO: 443402

SEQ ID NO: 760589 - RNA, 62 nt, hsa; identical to SEQ ID NO: 443403

SEQ ID NO: 760590 - RNA, 62 nt, hsa; identical to SEQ ID NO: 443404

SEQ ID NO: 760591 - RNA, 62 nt, hsa; identical to SEQ ID NO: 443405

SEQ ID NO: 760592 - RNA, 62 nt, hsa; identical to SEQ ID NO: 443406

SEQ ID NO: 760593 - RNA, 62 nt, hsa; identical to SEQ ID NO: 443407

SEQ ID NO: 760594 - RNA, 62 nt, hsa; identical to SEQ ID NO: 443408

SEQ ID NO: 760595 - RNA, 64 nt, hsa; identical to SEQ ID NO: 443409

SEQ ID NO: 760596 - RNA, 64 nt, hsa; identical to SEQ ID NO: 443410

SEQ ID NO: 760597 - RNA, 64 nt, hsa; identical to SEQ ID NO: 443411

SEQ ID NO: 760598 - RNA, 64 nt, hsa; identical to SEQ ID NO: 443412

SEQ ID NO: 760599 - RNA, 64 nt, hsa; identical to SEQ ID NO: 443413

SEQ ID NO: 760600 - RNA, 64 nt, hsa; identical to SEQ ID NO: 443414

SEQ ID NO: 760601 - RNA, 64 nt, hsa; identical to SEQ ID NO: 443415

SEQ ID NO: 760602 - RNA, 64 nt, hsa; identical to SEQ ID NO: 443416

SEQ ID NO: 760603 - RNA, 64 nt, hsa; identical to SEQ ID NO: 443417

SEQ ID NO: 760604 - RNA, 64 nt, hsa; identical to SEQ ID NO: 443418

SEQ ID NO: 760605 - RNA, 64 nt, hsa; identical to SEQ ID NO: 443419

SEQ ID NO: 760606 - RNA, 64 nt, hsa; identical to SEQ ID NO: 443420

SEQ ID NO: 760607 - RNA, 64 nt, hsa; identical to SEQ ID NO: 443421

SEQ ID NO: 760608 - RNA, 64 nt, hsa; identical to SEQ ID NO: 443422

SEQ ID NO: 760609 - RNA, 64 nt, hsa; identical to SEQ ID NO: 443423

SEQ ID NO: 760610 - RNA, 64 nt, hsa; identical to SEQ ID NO: 443424

SEQ ID NO: 760611 - RNA, 64 nt, hsa; identical to SEQ ID NO: 443425

SEQ ID NO: 760612 - RNA, 64 nt, hsa; identical to SEQ ID NO: 443426

SEQ ID NO: 760613 - RNA, 64 nt, hsa; identical to SEQ ID NO: 443427

SEQ ID NO: 760614 - RNA, 64 nt, hsa; identical to SEQ ID NO: 443428

SEQ ID NO: 760615 - RNA, 64 nt, hsa; identical to SEQ ID NO: 443429

SEQ ID NO: 760616 - RNA, 64 nt, hsa; identical to SEQ ID NO: 443430
